United States Patent 7,838,658 (SIRNA SILENCING OF FILOVIRUS GENE EXPRESSION) - sequence listing, part 2

SEQ ID NO: 27363 - RNA, 21 nt, Artificial Sequence
  Marburg virus siRNA sense strand
uugaugaaucuucuaguucug

SEQ ID NO: 27364 - RNA, 21 nt, Artificial Sequence
  Marburg virus siRNA sense strand
ugaugaaucuucuaguucugg

SEQ ID NO: 27365 - RNA, 21 nt, Artificial Sequence
  Marburg virus siRNA sense strand
gaugaaucuucuaguucuggu

SEQ ID NO: 27366 - RNA, 21 nt, Artificial Sequence
  Marburg virus siRNA sense strand
augaaucuucuaguucuggug

SEQ ID NO: 27367 - RNA, 21 nt, Artificial Sequence
  Marburg virus siRNA sense strand
ugaaucuucuaguucuggugc

SEQ ID NO: 27368 - RNA, 21 nt, Artificial Sequence
  Marburg virus siRNA sense strand
gaaucuucuaguucuggugcu

SEQ ID NO: 27369 - RNA, 21 nt, Artificial Sequence
  Marburg virus siRNA sense strand
aaucuucuaguucuggugcuu

SEQ ID NO: 27370 - RNA, 21 nt, Artificial Sequence
  Marburg virus siRNA sense strand
aucuucuaguucuggugcuuc

SEQ ID NO: 27371 - RNA, 21 nt, Artificial Sequence
  Marburg virus siRNA sense strand
ucuucuaguucuggugcuucg

SEQ ID NO: 27372 - RNA, 21 nt, Artificial Sequence
  Marburg virus siRNA sense strand
cuucuaguucuggugcuucgg

SEQ ID NO: 27373 - RNA, 21 nt, Artificial Sequence
  Marburg virus siRNA sense strand
uucuaguucuggugcuucggc

SEQ ID NO: 27374 - RNA, 21 nt, Artificial Sequence
  Marburg virus siRNA sense strand
ucuaguucuggugcuucggcu

SEQ ID NO: 27375 - RNA, 21 nt, Artificial Sequence
  Marburg virus siRNA sense strand
cuaguucuggugcuucggcug

SEQ ID NO: 27376 - RNA, 21 nt, Artificial Sequence
  Marburg virus siRNA sense strand
uaguucuggugcuucggcuga

SEQ ID NO: 27377 - RNA, 21 nt, Artificial Sequence
  Marburg virus siRNA sense strand
aguucuggugcuucggcugag

SEQ ID NO: 27378 - RNA, 21 nt, Artificial Sequence
  Marburg virus siRNA sense strand
guucuggugcuucggcugagg

SEQ ID NO: 27379 - RNA, 21 nt, Artificial Sequence
  Marburg virus siRNA sense strand
uucuggugcuucggcugagga

SEQ ID NO: 27380 - RNA, 21 nt, Artificial Sequence
  Marburg virus siRNA sense strand
ucuggugcuucggcugaggaa

SEQ ID NO: 27381 - RNA, 21 nt, Artificial Sequence
  Marburg virus siRNA sense strand
cuggugcuucggcugaggaag

SEQ ID NO: 27382 - RNA, 21 nt, Artificial Sequence
  Marburg virus siRNA sense strand
uggugcuucggcugaggaaga

SEQ ID NO: 27383 - RNA, 21 nt, Artificial Sequence
  Marburg virus siRNA sense strand
ggugcuucggcugaggaagau

SEQ ID NO: 27384 - RNA, 21 nt, Artificial Sequence
  Marburg virus siRNA sense strand
gugcuucggcugaggaagauc

SEQ ID NO: 27385 - RNA, 21 nt, Artificial Sequence
  Marburg virus siRNA sense strand
ugcuucggcugaggaagauca

SEQ ID NO: 27386 - RNA, 21 nt, Artificial Sequence
  Marburg virus siRNA sense strand
gcuucggcugaggaagaucaa

SEQ ID NO: 27387 - RNA, 21 nt, Artificial Sequence
  Marburg virus siRNA sense strand
cuucggcugaggaagaucaac

SEQ ID NO: 27388 - RNA, 21 nt, Artificial Sequence
  Marburg virus siRNA sense strand
uucggcugaggaagaucaaca

SEQ ID NO: 27389 - RNA, 21 nt, Artificial Sequence
  Marburg virus siRNA sense strand
ucggcugaggaagaucaacau

SEQ ID NO: 27390 - RNA, 21 nt, Artificial Sequence
  Marburg virus siRNA sense strand
cggcugaggaagaucaacaug

SEQ ID NO: 27391 - RNA, 21 nt, Artificial Sequence
  Marburg virus siRNA sense strand
ggcugaggaagaucaacaugc

SEQ ID NO: 27392 - RNA, 21 nt, Artificial Sequence
  Marburg virus siRNA sense strand
gcugaggaagaucaacaugcc

SEQ ID NO: 27393 - RNA, 21 nt, Artificial Sequence
  Marburg virus siRNA sense strand
cugaggaagaucaacaugccu

SEQ ID NO: 27394 - RNA, 21 nt, Artificial Sequence
  Marburg virus siRNA sense strand
ugaggaagaucaacaugccuc

SEQ ID NO: 27395 - RNA, 21 nt, Artificial Sequence
  Marburg virus siRNA sense strand
gaggaagaucaacaugccucc

SEQ ID NO: 27396 - RNA, 21 nt, Artificial Sequence
  Marburg virus siRNA sense strand
aggaagaucaacaugccuccc

SEQ ID NO: 27397 - RNA, 21 nt, Artificial Sequence
  Marburg virus siRNA sense strand
ggaagaucaacaugccucccc

SEQ ID NO: 27398 - RNA, 21 nt, Artificial Sequence
  Marburg virus siRNA sense strand
gaagaucaacaugccuccccc

SEQ ID NO: 27399 - RNA, 21 nt, Artificial Sequence
  Marburg virus siRNA sense strand
aagaucaacaugccuccccca

SEQ ID NO: 27400 - RNA, 21 nt, Artificial Sequence
  Marburg virus siRNA sense strand
agaucaacaugccucccccaa

SEQ ID NO: 27401 - RNA, 21 nt, Artificial Sequence
  Marburg virus siRNA sense strand
gaucaacaugccucccccaau

SEQ ID NO: 27402 - RNA, 21 nt, Artificial Sequence
  Marburg virus siRNA sense strand
aucaacaugccucccccaaua

SEQ ID NO: 27403 - RNA, 21 nt, Artificial Sequence
  Marburg virus siRNA sense strand
ucaacaugccucccccaauau

SEQ ID NO: 27404 - RNA, 21 nt, Artificial Sequence
  Marburg virus siRNA sense strand
caacaugccucccccaauauc

SEQ ID NO: 27405 - RNA, 21 nt, Artificial Sequence
  Marburg virus siRNA sense strand
aacaugccucccccaauauca

SEQ ID NO: 27406 - RNA, 21 nt, Artificial Sequence
  Marburg virus siRNA sense strand
acaugccucccccaauaucag

SEQ ID NO: 27407 - RNA, 21 nt, Artificial Sequence
  Marburg virus siRNA sense strand
caugccucccccaauaucagu

SEQ ID NO: 27408 - RNA, 21 nt, Artificial Sequence
  Marburg virus siRNA sense strand
augccucccccaauaucaguu

SEQ ID NO: 27409 - RNA, 21 nt, Artificial Sequence
  Marburg virus siRNA sense strand
ugccucccccaauaucaguuu

SEQ ID NO: 27410 - RNA, 21 nt, Artificial Sequence
  Marburg virus siRNA sense strand
gccucccccaauaucaguuua

SEQ ID NO: 27411 - RNA, 21 nt, Artificial Sequence
  Marburg virus siRNA sense strand
ccucccccaauaucaguuuaa

SEQ ID NO: 27412 - RNA, 21 nt, Artificial Sequence
  Marburg virus siRNA sense strand
cucccccaauaucaguuuaac

SEQ ID NO: 27413 - RNA, 21 nt, Artificial Sequence
  Marburg virus siRNA sense strand
ucccccaauaucaguuuaacu

SEQ ID NO: 27414 - RNA, 21 nt, Artificial Sequence
  Marburg virus siRNA sense strand
cccccaauaucaguuuaacuu

SEQ ID NO: 27415 - RNA, 21 nt, Artificial Sequence
  Marburg virus siRNA sense strand
ccccaauaucaguuuaacuuu

SEQ ID NO: 27416 - RNA, 21 nt, Artificial Sequence
  Marburg virus siRNA sense strand
cccaauaucaguuuaacuuua

SEQ ID NO: 27417 - RNA, 21 nt, Artificial Sequence
  Marburg virus siRNA sense strand
ccaauaucaguuuaacuuuau

SEQ ID NO: 27418 - RNA, 21 nt, Artificial Sequence
  Marburg virus siRNA sense strand
caauaucaguuuaacuuuauc

SEQ ID NO: 27419 - RNA, 21 nt, Artificial Sequence
  Marburg virus siRNA sense strand
aauaucaguuuaacuuuaucc

SEQ ID NO: 27420 - RNA, 21 nt, Artificial Sequence
  Marburg virus siRNA sense strand
auaucaguuuaacuuuauccu

SEQ ID NO: 27421 - RNA, 21 nt, Artificial Sequence
  Marburg virus siRNA sense strand
uaucaguuuaacuuuauccua

SEQ ID NO: 27422 - RNA, 21 nt, Artificial Sequence
  Marburg virus siRNA sense strand
aucaguuuaacuuuauccuau

SEQ ID NO: 27423 - RNA, 21 nt, Artificial Sequence
  Marburg virus siRNA sense strand
ucaguuuaacuuuauccuauu

SEQ ID NO: 27424 - RNA, 21 nt, Artificial Sequence
  Marburg virus siRNA sense strand
caguuuaacuuuauccuauuu

SEQ ID NO: 27425 - RNA, 21 nt, Artificial Sequence
  Marburg virus siRNA sense strand
aguuuaacuuuauccuauuuu

SEQ ID NO: 27426 - RNA, 21 nt, Artificial Sequence
  Marburg virus siRNA sense strand
guuuaacuuuauccuauuuuc

SEQ ID NO: 27427 - RNA, 21 nt, Artificial Sequence
  Marburg virus siRNA sense strand
uuuaacuuuauccuauuuucc

SEQ ID NO: 27428 - RNA, 21 nt, Artificial Sequence
  Marburg virus siRNA sense strand
uuaacuuuauccuauuuuccu

SEQ ID NO: 27429 - RNA, 21 nt, Artificial Sequence
  Marburg virus siRNA sense strand
uaacuuuauccuauuuuccua

SEQ ID NO: 27430 - RNA, 21 nt, Artificial Sequence
  Marburg virus siRNA sense strand
aacuuuauccuauuuuccuaa

SEQ ID NO: 27431 - RNA, 21 nt, Artificial Sequence
  Marburg virus siRNA sense strand
acuuuauccuauuuuccuaau

SEQ ID NO: 27432 - RNA, 21 nt, Artificial Sequence
  Marburg virus siRNA sense strand
cuuuauccuauuuuccuaaua

SEQ ID NO: 27433 - RNA, 21 nt, Artificial Sequence
  Marburg virus siRNA sense strand
uuuauccuauuuuccuaauau

SEQ ID NO: 27434 - RNA, 21 nt, Artificial Sequence
  Marburg virus siRNA sense strand
uuauccuauuuuccuaauaua

SEQ ID NO: 27435 - RNA, 21 nt, Artificial Sequence
  Marburg virus siRNA sense strand
uauccuauuuuccuaauauaa

SEQ ID NO: 27436 - RNA, 21 nt, Artificial Sequence
  Marburg virus siRNA sense strand
auccuauuuuccuaauauaaa

SEQ ID NO: 27437 - RNA, 21 nt, Artificial Sequence
  Marburg virus siRNA sense strand
uccuauuuuccuaauauaaau

SEQ ID NO: 27438 - RNA, 21 nt, Artificial Sequence
  Marburg virus siRNA sense strand
ccuauuuuccuaauauaaaug

SEQ ID NO: 27439 - RNA, 21 nt, Artificial Sequence
  Marburg virus siRNA sense strand
cuauuuuccuaauauaaauga

SEQ ID NO: 27440 - RNA, 21 nt, Artificial Sequence
  Marburg virus siRNA sense strand
uauuuuccuaauauaaaugaa

SEQ ID NO: 27441 - RNA, 21 nt, Artificial Sequence
  Marburg virus siRNA sense strand
auuuuccuaauauaaaugaaa

SEQ ID NO: 27442 - RNA, 21 nt, Artificial Sequence
  Marburg virus siRNA sense strand
uuuuccuaauauaaaugaaaa

SEQ ID NO: 27443 - RNA, 21 nt, Artificial Sequence
  Marburg virus siRNA sense strand
uuuccuaauauaaaugaaaac

SEQ ID NO: 27444 - RNA, 21 nt, Artificial Sequence
  Marburg virus siRNA sense strand
uuccuaauauaaaugaaaaca

SEQ ID NO: 27445 - RNA, 21 nt, Artificial Sequence
  Marburg virus siRNA sense strand
uccuaauauaaaugaaaacac

SEQ ID NO: 27446 - RNA, 21 nt, Artificial Sequence
  Marburg virus siRNA sense strand
ccuaauauaaaugaaaacacu

SEQ ID NO: 27447 - RNA, 21 nt, Artificial Sequence
  Marburg virus siRNA sense strand
cuaauauaaaugaaaacacug

SEQ ID NO: 27448 - RNA, 21 nt, Artificial Sequence
  Marburg virus siRNA sense strand
uaauauaaaugaaaacacugc

SEQ ID NO: 27449 - RNA, 21 nt, Artificial Sequence
  Marburg virus siRNA sense strand
aauauaaaugaaaacacugcc

SEQ ID NO: 27450 - RNA, 21 nt, Artificial Sequence
  Marburg virus siRNA sense strand
auauaaaugaaaacacugccu

SEQ ID NO: 27451 - RNA, 21 nt, Artificial Sequence
  Marburg virus siRNA sense strand
uauaaaugaaaacacugccua

SEQ ID NO: 27452 - RNA, 21 nt, Artificial Sequence
  Marburg virus siRNA sense strand
auaaaugaaaacacugccuac

SEQ ID NO: 27453 - RNA, 21 nt, Artificial Sequence
  Marburg virus siRNA sense strand
uaaaugaaaacacugccuacu

SEQ ID NO: 27454 - RNA, 21 nt, Artificial Sequence
  Marburg virus siRNA sense strand
aaaugaaaacacugccuacuc

SEQ ID NO: 27455 - RNA, 21 nt, Artificial Sequence
  Marburg virus siRNA sense strand
aaugaaaacacugccuacucu

SEQ ID NO: 27456 - RNA, 21 nt, Artificial Sequence
  Marburg virus siRNA sense strand
augaaaacacugccuacucug

SEQ ID NO: 27457 - RNA, 21 nt, Artificial Sequence
  Marburg virus siRNA sense strand
ugaaaacacugccuacucugg

SEQ ID NO: 27458 - RNA, 21 nt, Artificial Sequence
  Marburg virus siRNA sense strand
gaaaacacugccuacucugga

SEQ ID NO: 27459 - RNA, 21 nt, Artificial Sequence
  Marburg virus siRNA sense strand
aaaacacugccuacucuggag

SEQ ID NO: 27460 - RNA, 21 nt, Artificial Sequence
  Marburg virus siRNA sense strand
aaacacugccuacucuggaga

SEQ ID NO: 27461 - RNA, 21 nt, Artificial Sequence
  Marburg virus siRNA sense strand
aacacugccuacucuggagaa

SEQ ID NO: 27462 - RNA, 21 nt, Artificial Sequence
  Marburg virus siRNA sense strand
acacugccuacucuggagaaa

SEQ ID NO: 27463 - RNA, 21 nt, Artificial Sequence
  Marburg virus siRNA sense strand
cacugccuacucuggagaaaa

SEQ ID NO: 27464 - RNA, 21 nt, Artificial Sequence
  Marburg virus siRNA sense strand
acugccuacucuggagaaaau

SEQ ID NO: 27465 - RNA, 21 nt, Artificial Sequence
  Marburg virus siRNA sense strand
cugccuacucuggagaaaaug

SEQ ID NO: 27466 - RNA, 21 nt, Artificial Sequence
  Marburg virus siRNA sense strand
ugccuacucuggagaaaauga

SEQ ID NO: 27467 - RNA, 21 nt, Artificial Sequence
  Marburg virus siRNA sense strand
gccuacucuggagaaaaugag

SEQ ID NO: 27468 - RNA, 21 nt, Artificial Sequence
  Marburg virus siRNA sense strand
ccuacucuggagaaaaugaga

SEQ ID NO: 27469 - RNA, 21 nt, Artificial Sequence
  Marburg virus siRNA sense strand
cuacucuggagaaaaugagaa

SEQ ID NO: 27470 - RNA, 21 nt, Artificial Sequence
  Marburg virus siRNA sense strand
uacucuggagaaaaugagaac

SEQ ID NO: 27471 - RNA, 21 nt, Artificial Sequence
  Marburg virus siRNA sense strand
acucuggagaaaaugagaacg

SEQ ID NO: 27472 - RNA, 21 nt, Artificial Sequence
  Marburg virus siRNA sense strand
cucuggagaaaaugagaacga

SEQ ID NO: 27473 - RNA, 21 nt, Artificial Sequence
  Marburg virus siRNA sense strand
ucuggagaaaaugagaacgau

SEQ ID NO: 27474 - RNA, 21 nt, Artificial Sequence
  Marburg virus siRNA sense strand
cuggagaaaaugagaacgauu

SEQ ID NO: 27475 - RNA, 21 nt, Artificial Sequence
  Marburg virus siRNA sense strand
uggagaaaaugagaacgauug

SEQ ID NO: 27476 - RNA, 21 nt, Artificial Sequence
  Marburg virus siRNA sense strand
ggagaaaaugagaacgauugu

SEQ ID NO: 27477 - RNA, 21 nt, Artificial Sequence
  Marburg virus siRNA sense strand
gagaaaaugagaacgauugug

SEQ ID NO: 27478 - RNA, 21 nt, Artificial Sequence
  Marburg virus siRNA sense strand
agaaaaugagaacgauuguga

SEQ ID NO: 27479 - RNA, 21 nt, Artificial Sequence
  Marburg virus siRNA sense strand
gaaaaugagaacgauugugau

SEQ ID NO: 27480 - RNA, 21 nt, Artificial Sequence
  Marburg virus siRNA sense strand
aaaaugagaacgauugugaug

SEQ ID NO: 27481 - RNA, 21 nt, Artificial Sequence
  Marburg virus siRNA sense strand
aaaugagaacgauugugaugc

SEQ ID NO: 27482 - RNA, 21 nt, Artificial Sequence
  Marburg virus siRNA sense strand
aaugagaacgauugugaugca

SEQ ID NO: 27483 - RNA, 21 nt, Artificial Sequence
  Marburg virus siRNA sense strand
augagaacgauugugaugcag

SEQ ID NO: 27484 - RNA, 21 nt, Artificial Sequence
  Marburg virus siRNA sense strand
ugagaacgauugugaugcaga

SEQ ID NO: 27485 - RNA, 21 nt, Artificial Sequence
  Marburg virus siRNA sense strand
gagaacgauugugaugcagag

SEQ ID NO: 27486 - RNA, 21 nt, Artificial Sequence
  Marburg virus siRNA sense strand
agaacgauugugaugcagagu

SEQ ID NO: 27487 - RNA, 21 nt, Artificial Sequence
  Marburg virus siRNA sense strand
gaacgauugugaugcagaguu

SEQ ID NO: 27488 - RNA, 21 nt, Artificial Sequence
  Marburg virus siRNA sense strand
aacgauugugaugcagaguua

SEQ ID NO: 27489 - RNA, 21 nt, Artificial Sequence
  Marburg virus siRNA sense strand
acgauugugaugcagaguuaa

SEQ ID NO: 27490 - RNA, 21 nt, Artificial Sequence
  Marburg virus siRNA sense strand
cgauugugaugcagaguuaag

SEQ ID NO: 27491 - RNA, 21 nt, Artificial Sequence
  Marburg virus siRNA sense strand
gauugugaugcagaguuaaga

SEQ ID NO: 27492 - RNA, 21 nt, Artificial Sequence
  Marburg virus siRNA sense strand
auugugaugcagaguuaagaa

SEQ ID NO: 27493 - RNA, 21 nt, Artificial Sequence
  Marburg virus siRNA sense strand
uugugaugcagaguuaagaau

SEQ ID NO: 27494 - RNA, 21 nt, Artificial Sequence
  Marburg virus siRNA sense strand
ugugaugcagaguuaagaauu

SEQ ID NO: 27495 - RNA, 21 nt, Artificial Sequence
  Marburg virus siRNA sense strand
gugaugcagaguuaagaauuu

SEQ ID NO: 27496 - RNA, 21 nt, Artificial Sequence
  Marburg virus siRNA sense strand
ugaugcagaguuaagaauuug

SEQ ID NO: 27497 - RNA, 21 nt, Artificial Sequence
  Marburg virus siRNA sense strand
gaugcagaguuaagaauuugg

SEQ ID NO: 27498 - RNA, 21 nt, Artificial Sequence
  Marburg virus siRNA sense strand
augcagaguuaagaauuugga

SEQ ID NO: 27499 - RNA, 21 nt, Artificial Sequence
  Marburg virus siRNA sense strand
ugcagaguuaagaauuuggag

SEQ ID NO: 27500 - RNA, 21 nt, Artificial Sequence
  Marburg virus siRNA sense strand
gcagaguuaagaauuuggagc

SEQ ID NO: 27501 - RNA, 21 nt, Artificial Sequence
  Marburg virus siRNA sense strand
cagaguuaagaauuuggagcg

SEQ ID NO: 27502 - RNA, 21 nt, Artificial Sequence
  Marburg virus siRNA sense strand
agaguuaagaauuuggagcgu

SEQ ID NO: 27503 - RNA, 21 nt, Artificial Sequence
  Marburg virus siRNA sense strand
gaguuaagaauuuggagcguu

SEQ ID NO: 27504 - RNA, 21 nt, Artificial Sequence
  Marburg virus siRNA sense strand
aguuaagaauuuggagcguuc

SEQ ID NO: 27505 - RNA, 21 nt, Artificial Sequence
  Marburg virus siRNA sense strand
guuaagaauuuggagcguuca

SEQ ID NO: 27506 - RNA, 21 nt, Artificial Sequence
  Marburg virus siRNA sense strand
uuaagaauuuggagcguucag

SEQ ID NO: 27507 - RNA, 21 nt, Artificial Sequence
  Marburg virus siRNA sense strand
uaagaauuuggagcguucagg

SEQ ID NO: 27508 - RNA, 21 nt, Artificial Sequence
  Marburg virus siRNA sense strand
aagaauuuggagcguucagga

SEQ ID NO: 27509 - RNA, 21 nt, Artificial Sequence
  Marburg virus siRNA sense strand
agaauuuggagcguucaggag

SEQ ID NO: 27510 - RNA, 21 nt, Artificial Sequence
  Marburg virus siRNA sense strand
gaauuuggagcguucaggagg

SEQ ID NO: 27511 - RNA, 21 nt, Artificial Sequence
  Marburg virus siRNA sense strand
aauuuggagcguucaggagga

SEQ ID NO: 27512 - RNA, 21 nt, Artificial Sequence
  Marburg virus siRNA sense strand
auuuggagcguucaggaggau

SEQ ID NO: 27513 - RNA, 21 nt, Artificial Sequence
  Marburg virus siRNA sense strand
uuuggagcguucaggaggaug

SEQ ID NO: 27514 - RNA, 21 nt, Artificial Sequence
  Marburg virus siRNA sense strand
uuggagcguucaggaggauga

SEQ ID NO: 27515 - RNA, 21 nt, Artificial Sequence
  Marburg virus siRNA sense strand
uggagcguucaggaggaugac

SEQ ID NO: 27516 - RNA, 21 nt, Artificial Sequence
  Marburg virus siRNA sense strand
ggagcguucaggaggaugacc

SEQ ID NO: 27517 - RNA, 21 nt, Artificial Sequence
  Marburg virus siRNA sense strand
gagcguucaggaggaugaccu

SEQ ID NO: 27518 - RNA, 21 nt, Artificial Sequence
  Marburg virus siRNA sense strand
agcguucaggaggaugaccug

SEQ ID NO: 27519 - RNA, 21 nt, Artificial Sequence
  Marburg virus siRNA sense strand
gcguucaggaggaugaccugg

SEQ ID NO: 27520 - RNA, 21 nt, Artificial Sequence
  Marburg virus siRNA sense strand
cguucaggaggaugaccuggc

SEQ ID NO: 27521 - RNA, 21 nt, Artificial Sequence
  Marburg virus siRNA sense strand
guucaggaggaugaccuggca

SEQ ID NO: 27522 - RNA, 21 nt, Artificial Sequence
  Marburg virus siRNA sense strand
uucaggaggaugaccuggcag

SEQ ID NO: 27523 - RNA, 21 nt, Artificial Sequence
  Marburg virus siRNA sense strand
ucaggaggaugaccuggcagc

SEQ ID NO: 27524 - RNA, 21 nt, Artificial Sequence
  Marburg virus siRNA sense strand
caggaggaugaccuggcagca

SEQ ID NO: 27525 - RNA, 21 nt, Artificial Sequence
  Marburg virus siRNA sense strand
aggaggaugaccuggcagcag

SEQ ID NO: 27526 - RNA, 21 nt, Artificial Sequence
  Marburg virus siRNA sense strand
ggaggaugaccuggcagcagg

SEQ ID NO: 27527 - RNA, 21 nt, Artificial Sequence
  Marburg virus siRNA sense strand
gaggaugaccuggcagcaggg

SEQ ID NO: 27528 - RNA, 21 nt, Artificial Sequence
  Marburg virus siRNA sense strand
aggaugaccuggcagcagggc

SEQ ID NO: 27529 - RNA, 21 nt, Artificial Sequence
  Marburg virus siRNA sense strand
ggaugaccuggcagcagggcu

SEQ ID NO: 27530 - RNA, 21 nt, Artificial Sequence
  Marburg virus siRNA sense strand
gaugaccuggcagcagggcuc

SEQ ID NO: 27531 - RNA, 21 nt, Artificial Sequence
  Marburg virus siRNA sense strand
augaccuggcagcagggcuca

SEQ ID NO: 27532 - RNA, 21 nt, Artificial Sequence
  Marburg virus siRNA sense strand
ugaccuggcagcagggcucag

SEQ ID NO: 27533 - RNA, 21 nt, Artificial Sequence
  Marburg virus siRNA sense strand
gaccuggcagcagggcucagu

SEQ ID NO: 27534 - RNA, 21 nt, Artificial Sequence
  Marburg virus siRNA sense strand
accuggcagcagggcucaguu

SEQ ID NO: 27535 - RNA, 21 nt, Artificial Sequence
  Marburg virus siRNA sense strand
ccuggcagcagggcucaguug

SEQ ID NO: 27536 - RNA, 21 nt, Artificial Sequence
  Marburg virus siRNA sense strand
cuggcagcagggcucaguugg

SEQ ID NO: 27537 - RNA, 21 nt, Artificial Sequence
  Marburg virus siRNA sense strand
uggcagcagggcucaguugga

SEQ ID NO: 27538 - RNA, 21 nt, Artificial Sequence
  Marburg virus siRNA sense strand
ggcagcagggcucaguuggau

SEQ ID NO: 27539 - RNA, 21 nt, Artificial Sequence
  Marburg virus siRNA sense strand
gcagcagggcucaguuggaua

SEQ ID NO: 27540 - RNA, 21 nt, Artificial Sequence
  Marburg virus siRNA sense strand
cagcagggcucaguuggauac

SEQ ID NO: 27541 - RNA, 21 nt, Artificial Sequence
  Marburg virus siRNA sense strand
agcagggcucaguuggauacc

SEQ ID NO: 27542 - RNA, 21 nt, Artificial Sequence
  Marburg virus siRNA sense strand
gcagggcucaguuggauaccg

SEQ ID NO: 27543 - RNA, 21 nt, Artificial Sequence
  Marburg virus siRNA sense strand
cagggcucaguuggauaccgu

SEQ ID NO: 27544 - RNA, 21 nt, Artificial Sequence
  Marburg virus siRNA sense strand
agggcucaguuggauaccguu

SEQ ID NO: 27545 - RNA, 21 nt, Artificial Sequence
  Marburg virus siRNA sense strand
gggcucaguuggauaccguuu

SEQ ID NO: 27546 - RNA, 21 nt, Artificial Sequence
  Marburg virus siRNA sense strand
ggcucaguuggauaccguuuu

SEQ ID NO: 27547 - RNA, 21 nt, Artificial Sequence
  Marburg virus siRNA sense strand
gcucaguuggauaccguuuuu

SEQ ID NO: 27548 - RNA, 21 nt, Artificial Sequence
  Marburg virus siRNA sense strand
cucaguuggauaccguuuuuu

SEQ ID NO: 27549 - RNA, 21 nt, Artificial Sequence
  Marburg virus siRNA sense strand
ucaguuggauaccguuuuuug

SEQ ID NO: 27550 - RNA, 21 nt, Artificial Sequence
  Marburg virus siRNA sense strand
caguuggauaccguuuuuugg

SEQ ID NO: 27551 - RNA, 21 nt, Artificial Sequence
  Marburg virus siRNA sense strand
aguuggauaccguuuuuuggc

SEQ ID NO: 27552 - RNA, 21 nt, Artificial Sequence
  Marburg virus siRNA sense strand
guuggauaccguuuuuuggcc

SEQ ID NO: 27553 - RNA, 21 nt, Artificial Sequence
  Marburg virus siRNA sense strand
uuggauaccguuuuuuggccc

SEQ ID NO: 27554 - RNA, 21 nt, Artificial Sequence
  Marburg virus siRNA sense strand
uggauaccguuuuuuggcccu

SEQ ID NO: 27555 - RNA, 21 nt, Artificial Sequence
  Marburg virus siRNA sense strand
ggauaccguuuuuuggcccug

SEQ ID NO: 27556 - RNA, 21 nt, Artificial Sequence
  Marburg virus siRNA sense strand
gauaccguuuuuuggcccugg

SEQ ID NO: 27557 - RNA, 21 nt, Artificial Sequence
  Marburg virus siRNA sense strand
auaccguuuuuuggcccugga

SEQ ID NO: 27558 - RNA, 21 nt, Artificial Sequence
  Marburg virus siRNA sense strand
uaccguuuuuuggcccuggaa

SEQ ID NO: 27559 - RNA, 21 nt, Artificial Sequence
  Marburg virus siRNA sense strand
accguuuuuuggcccuggaau

SEQ ID NO: 27560 - RNA, 21 nt, Artificial Sequence
  Marburg virus siRNA sense strand
ccguuuuuuggcccuggaauc

SEQ ID NO: 27561 - RNA, 21 nt, Artificial Sequence
  Marburg virus siRNA sense strand
cguuuuuuggcccuggaaucg

SEQ ID NO: 27562 - RNA, 21 nt, Artificial Sequence
  Marburg virus siRNA sense strand
guuuuuuggcccuggaaucga

SEQ ID NO: 27563 - RNA, 21 nt, Artificial Sequence
  Marburg virus siRNA sense strand
uuuuuuggcccuggaaucgaa

SEQ ID NO: 27564 - RNA, 21 nt, Artificial Sequence
  Marburg virus siRNA sense strand
uuuuuggcccuggaaucgaag

SEQ ID NO: 27565 - RNA, 21 nt, Artificial Sequence
  Marburg virus siRNA sense strand
uuuuggcccuggaaucgaagg

SEQ ID NO: 27566 - RNA, 21 nt, Artificial Sequence
  Marburg virus siRNA sense strand
uuuggcccuggaaucgaagga

SEQ ID NO: 27567 - RNA, 21 nt, Artificial Sequence
  Marburg virus siRNA sense strand
uuggcccuggaaucgaaggac

SEQ ID NO: 27568 - RNA, 21 nt, Artificial Sequence
  Marburg virus siRNA sense strand
uggcccuggaaucgaaggacu

SEQ ID NO: 27569 - RNA, 21 nt, Artificial Sequence
  Marburg virus siRNA sense strand
ggcccuggaaucgaaggacuu

SEQ ID NO: 27570 - RNA, 21 nt, Artificial Sequence
  Marburg virus siRNA sense strand
gcccuggaaucgaaggacuuu

SEQ ID NO: 27571 - RNA, 21 nt, Artificial Sequence
  Marburg virus siRNA sense strand
cccuggaaucgaaggacuuua

SEQ ID NO: 27572 - RNA, 21 nt, Artificial Sequence
  Marburg virus siRNA sense strand
ccuggaaucgaaggacuuuau

SEQ ID NO: 27573 - RNA, 21 nt, Artificial Sequence
  Marburg virus siRNA sense strand
cuggaaucgaaggacuuuaua

SEQ ID NO: 27574 - RNA, 21 nt, Artificial Sequence
  Marburg virus siRNA sense strand
uggaaucgaaggacuuuauac

SEQ ID NO: 27575 - RNA, 21 nt, Artificial Sequence
  Marburg virus siRNA sense strand
ggaaucgaaggacuuuauacu

SEQ ID NO: 27576 - RNA, 21 nt, Artificial Sequence
  Marburg virus siRNA sense strand
gaaucgaaggacuuuauacug

SEQ ID NO: 27577 - RNA, 21 nt, Artificial Sequence
  Marburg virus siRNA sense strand
aaucgaaggacuuuauacugc

SEQ ID NO: 27578 - RNA, 21 nt, Artificial Sequence
  Marburg virus siRNA sense strand
aucgaaggacuuuauacugcu

SEQ ID NO: 27579 - RNA, 21 nt, Artificial Sequence
  Marburg virus siRNA sense strand
ucgaaggacuuuauacugcug

SEQ ID NO: 27580 - RNA, 21 nt, Artificial Sequence
  Marburg virus siRNA sense strand
cgaaggacuuuauacugcugg

SEQ ID NO: 27581 - RNA, 21 nt, Artificial Sequence
  Marburg virus siRNA sense strand
gaaggacuuuauacugcuggu

SEQ ID NO: 27582 - RNA, 21 nt, Artificial Sequence
  Marburg virus siRNA sense strand
aaggacuuuauacugcugguu

SEQ ID NO: 27583 - RNA, 21 nt, Artificial Sequence
  Marburg virus siRNA sense strand
aggacuuuauacugcugguuu

SEQ ID NO: 27584 - RNA, 21 nt, Artificial Sequence
  Marburg virus siRNA sense strand
ggacuuuauacugcugguuua

SEQ ID NO: 27585 - RNA, 21 nt, Artificial Sequence
  Marburg virus siRNA sense strand
gacuuuauacugcugguuuaa

SEQ ID NO: 27586 - RNA, 21 nt, Artificial Sequence
  Marburg virus siRNA sense strand
acuuuauacugcugguuuaau

SEQ ID NO: 27587 - RNA, 21 nt, Artificial Sequence
  Marburg virus siRNA sense strand
cuuuauacugcugguuuaauu

SEQ ID NO: 27588 - RNA, 21 nt, Artificial Sequence
  Marburg virus siRNA sense strand
uuuauacugcugguuuaauua

SEQ ID NO: 27589 - RNA, 21 nt, Artificial Sequence
  Marburg virus siRNA sense strand
uuauacugcugguuuaauuaa

SEQ ID NO: 27590 - RNA, 21 nt, Artificial Sequence
  Marburg virus siRNA sense strand
uauacugcugguuuaauuaaa

SEQ ID NO: 27591 - RNA, 21 nt, Artificial Sequence
  Marburg virus siRNA sense strand
auacugcugguuuaauuaaaa

SEQ ID NO: 27592 - RNA, 21 nt, Artificial Sequence
  Marburg virus siRNA sense strand
uacugcugguuuaauuaaaaa

SEQ ID NO: 27593 - RNA, 21 nt, Artificial Sequence
  Marburg virus siRNA sense strand
acugcugguuuaauuaaaaac

SEQ ID NO: 27594 - RNA, 21 nt, Artificial Sequence
  Marburg virus siRNA sense strand
cugcugguuuaauuaaaaacc

SEQ ID NO: 27595 - RNA, 21 nt, Artificial Sequence
  Marburg virus siRNA sense strand
ugcugguuuaauuaaaaacca

SEQ ID NO: 27596 - RNA, 21 nt, Artificial Sequence
  Marburg virus siRNA sense strand
gcugguuuaauuaaaaaccaa

SEQ ID NO: 27597 - RNA, 21 nt, Artificial Sequence
  Marburg virus siRNA sense strand
cugguuuaauuaaaaaccaaa

SEQ ID NO: 27598 - RNA, 21 nt, Artificial Sequence
  Marburg virus siRNA sense strand
ugguuuaauuaaaaaccaaaa

SEQ ID NO: 27599 - RNA, 21 nt, Artificial Sequence
  Marburg virus siRNA sense strand
gguuuaauuaaaaaccaaaac

SEQ ID NO: 27600 - RNA, 21 nt, Artificial Sequence
  Marburg virus siRNA sense strand
guuuaauuaaaaaccaaaaca

SEQ ID NO: 27601 - RNA, 21 nt, Artificial Sequence
  Marburg virus siRNA sense strand
uuuaauuaaaaaccaaaacaa

SEQ ID NO: 27602 - RNA, 21 nt, Artificial Sequence
  Marburg virus siRNA sense strand
uuaauuaaaaaccaaaacaau

SEQ ID NO: 27603 - RNA, 21 nt, Artificial Sequence
  Marburg virus siRNA sense strand
uaauuaaaaaccaaaacaauu

SEQ ID NO: 27604 - RNA, 21 nt, Artificial Sequence
  Marburg virus siRNA sense strand
aauuaaaaaccaaaacaauuu

SEQ ID NO: 27605 - RNA, 21 nt, Artificial Sequence
  Marburg virus siRNA sense strand
auuaaaaaccaaaacaauuug

SEQ ID NO: 27606 - RNA, 21 nt, Artificial Sequence
  Marburg virus siRNA sense strand
uuaaaaaccaaaacaauuugg

SEQ ID NO: 27607 - RNA, 21 nt, Artificial Sequence
  Marburg virus siRNA sense strand
uaaaaaccaaaacaauuuggu

SEQ ID NO: 27608 - RNA, 21 nt, Artificial Sequence
  Marburg virus siRNA sense strand
aaaaaccaaaacaauuugguc

SEQ ID NO: 27609 - RNA, 21 nt, Artificial Sequence
  Marburg virus siRNA sense strand
aaaaccaaaacaauuuggucu

SEQ ID NO: 27610 - RNA, 21 nt, Artificial Sequence
  Marburg virus siRNA sense strand
aaaccaaaacaauuuggucug

SEQ ID NO: 27611 - RNA, 21 nt, Artificial Sequence
  Marburg virus siRNA sense strand
aaccaaaacaauuuggucugc

SEQ ID NO: 27612 - RNA, 21 nt, Artificial Sequence
  Marburg virus siRNA sense strand
accaaaacaauuuggucugca

SEQ ID NO: 27613 - RNA, 21 nt, Artificial Sequence
  Marburg virus siRNA sense strand
ccaaaacaauuuggucugcag

SEQ ID NO: 27614 - RNA, 21 nt, Artificial Sequence
  Marburg virus siRNA sense strand
caaaacaauuuggucugcagg

SEQ ID NO: 27615 - RNA, 21 nt, Artificial Sequence
  Marburg virus siRNA sense strand
aaaacaauuuggucugcaggu

SEQ ID NO: 27616 - RNA, 21 nt, Artificial Sequence
  Marburg virus siRNA sense strand
aaacaauuuggucugcagguu

SEQ ID NO: 27617 - RNA, 21 nt, Artificial Sequence
  Marburg virus siRNA sense strand
aacaauuuggucugcagguug

SEQ ID NO: 27618 - RNA, 21 nt, Artificial Sequence
  Marburg virus siRNA sense strand
acaauuuggucugcagguuga

SEQ ID NO: 27619 - RNA, 21 nt, Artificial Sequence
  Marburg virus siRNA sense strand
caauuuggucugcagguugag

SEQ ID NO: 27620 - RNA, 21 nt, Artificial Sequence
  Marburg virus siRNA sense strand
aauuuggucugcagguugagg

SEQ ID NO: 27621 - RNA, 21 nt, Artificial Sequence
  Marburg virus siRNA sense strand
auuuggucugcagguugaggc

SEQ ID NO: 27622 - RNA, 21 nt, Artificial Sequence
  Marburg virus siRNA sense strand
uuuggucugcagguugaggcg

SEQ ID NO: 27623 - RNA, 21 nt, Artificial Sequence
  Marburg virus siRNA sense strand
uuggucugcagguugaggcgu

SEQ ID NO: 27624 - RNA, 21 nt, Artificial Sequence
  Marburg virus siRNA sense strand
uggucugcagguugaggcguc

SEQ ID NO: 27625 - RNA, 21 nt, Artificial Sequence
  Marburg virus siRNA sense strand
ggucugcagguugaggcgucu

SEQ ID NO: 27626 - RNA, 21 nt, Artificial Sequence
  Marburg virus siRNA sense strand
gucugcagguugaggcgucua

SEQ ID NO: 27627 - RNA, 21 nt, Artificial Sequence
  Marburg virus siRNA sense strand
ucugcagguugaggcgucuag

SEQ ID NO: 27628 - RNA, 21 nt, Artificial Sequence
  Marburg virus siRNA sense strand
cugcagguugaggcgucuagc

SEQ ID NO: 27629 - RNA, 21 nt, Artificial Sequence
  Marburg virus siRNA sense strand
ugcagguugaggcgucuagcc

SEQ ID NO: 27630 - RNA, 21 nt, Artificial Sequence
  Marburg virus siRNA sense strand
gcagguugaggcgucuagcca

SEQ ID NO: 27631 - RNA, 21 nt, Artificial Sequence
  Marburg virus siRNA sense strand
cagguugaggcgucuagccaa

SEQ ID NO: 27632 - RNA, 21 nt, Artificial Sequence
  Marburg virus siRNA sense strand
agguugaggcgucuagccaau

SEQ ID NO: 27633 - RNA, 21 nt, Artificial Sequence
  Marburg virus siRNA sense strand
gguugaggcgucuagccaauc

SEQ ID NO: 27634 - RNA, 21 nt, Artificial Sequence
  Marburg virus siRNA sense strand
guugaggcgucuagccaauca

SEQ ID NO: 27635 - RNA, 21 nt, Artificial Sequence
  Marburg virus siRNA sense strand
uugaggcgucuagccaaucaa

SEQ ID NO: 27636 - RNA, 21 nt, Artificial Sequence
  Marburg virus siRNA sense strand
ugaggcgucuagccaaucaaa

SEQ ID NO: 27637 - RNA, 21 nt, Artificial Sequence
  Marburg virus siRNA sense strand
gaggcgucuagccaaucaaac

SEQ ID NO: 27638 - RNA, 21 nt, Artificial Sequence
  Marburg virus siRNA sense strand
aggcgucuagccaaucaaacu

SEQ ID NO: 27639 - RNA, 21 nt, Artificial Sequence
  Marburg virus siRNA sense strand
ggcgucuagccaaucaaacug

SEQ ID NO: 27640 - RNA, 21 nt, Artificial Sequence
  Marburg virus siRNA sense strand
gcgucuagccaaucaaacugc

SEQ ID NO: 27641 - RNA, 21 nt, Artificial Sequence
  Marburg virus siRNA sense strand
cgucuagccaaucaaacugcc

SEQ ID NO: 27642 - RNA, 21 nt, Artificial Sequence
  Marburg virus siRNA sense strand
gucuagccaaucaaacugcca

SEQ ID NO: 27643 - RNA, 21 nt, Artificial Sequence
  Marburg virus siRNA sense strand
ucuagccaaucaaacugccaa

SEQ ID NO: 27644 - RNA, 21 nt, Artificial Sequence
  Marburg virus siRNA sense strand
cuagccaaucaaacugccaaa

SEQ ID NO: 27645 - RNA, 21 nt, Artificial Sequence
  Marburg virus siRNA sense strand
uagccaaucaaacugccaaau

SEQ ID NO: 27646 - RNA, 21 nt, Artificial Sequence
  Marburg virus siRNA sense strand
agccaaucaaacugccaaauc

SEQ ID NO: 27647 - RNA, 21 nt, Artificial Sequence
  Marburg virus siRNA sense strand
gccaaucaaacugccaaaucc

SEQ ID NO: 27648 - RNA, 21 nt, Artificial Sequence
  Marburg virus siRNA sense strand
ccaaucaaacugccaaauccu

SEQ ID NO: 27649 - RNA, 21 nt, Artificial Sequence
  Marburg virus siRNA sense strand
caaucaaacugccaaauccuu

SEQ ID NO: 27650 - RNA, 21 nt, Artificial Sequence
  Marburg virus siRNA sense strand
aaucaaacugccaaauccuug

SEQ ID NO: 27651 - RNA, 21 nt, Artificial Sequence
  Marburg virus siRNA sense strand
aucaaacugccaaauccuugg

SEQ ID NO: 27652 - RNA, 21 nt, Artificial Sequence
  Marburg virus siRNA sense strand
ucaaacugccaaauccuugga

SEQ ID NO: 27653 - RNA, 21 nt, Artificial Sequence
  Marburg virus siRNA sense strand
caaacugccaaauccuuggaa

SEQ ID NO: 27654 - RNA, 21 nt, Artificial Sequence
  Marburg virus siRNA sense strand
aaacugccaaauccuuggaac

SEQ ID NO: 27655 - RNA, 21 nt, Artificial Sequence
  Marburg virus siRNA sense strand
aacugccaaauccuuggaacu

SEQ ID NO: 27656 - RNA, 21 nt, Artificial Sequence
  Marburg virus siRNA sense strand
acugccaaauccuuggaacuc

SEQ ID NO: 27657 - RNA, 21 nt, Artificial Sequence
  Marburg virus siRNA sense strand
cugccaaauccuuggaacucu

SEQ ID NO: 27658 - RNA, 21 nt, Artificial Sequence
  Marburg virus siRNA sense strand
ugccaaauccuuggaacucuu

SEQ ID NO: 27659 - RNA, 21 nt, Artificial Sequence
  Marburg virus siRNA sense strand
gccaaauccuuggaacucuua

SEQ ID NO: 27660 - RNA, 21 nt, Artificial Sequence
  Marburg virus siRNA sense strand
ccaaauccuuggaacucuuau

SEQ ID NO: 27661 - RNA, 21 nt, Artificial Sequence
  Marburg virus siRNA sense strand
caaauccuuggaacucuuauu

SEQ ID NO: 27662 - RNA, 21 nt, Artificial Sequence
  Marburg virus siRNA sense strand
aaauccuuggaacucuuauua

SEQ ID NO: 27663 - RNA, 21 nt, Artificial Sequence
  Marburg virus siRNA sense strand
aauccuuggaacucuuauuaa

SEQ ID NO: 27664 - RNA, 21 nt, Artificial Sequence
  Marburg virus siRNA sense strand
auccuuggaacucuuauuaag

SEQ ID NO: 27665 - RNA, 21 nt, Artificial Sequence
  Marburg virus siRNA sense strand
uccuuggaacucuuauuaaga

SEQ ID NO: 27666 - RNA, 21 nt, Artificial Sequence
  Marburg virus siRNA sense strand
ccuuggaacucuuauuaagag

SEQ ID NO: 27667 - RNA, 21 nt, Artificial Sequence
  Marburg virus siRNA sense strand
cuuggaacucuuauuaagagu

SEQ ID NO: 27668 - RNA, 21 nt, Artificial Sequence
  Marburg virus siRNA sense strand
uuggaacucuuauuaagaguc

SEQ ID NO: 27669 - RNA, 21 nt, Artificial Sequence
  Marburg virus siRNA sense strand
uggaacucuuauuaagaguca

SEQ ID NO: 27670 - RNA, 21 nt, Artificial Sequence
  Marburg virus siRNA sense strand
ggaacucuuauuaagagucac

SEQ ID NO: 27671 - RNA, 21 nt, Artificial Sequence
  Marburg virus siRNA sense strand
gaacucuuauuaagagucaca

SEQ ID NO: 27672 - RNA, 21 nt, Artificial Sequence
  Marburg virus siRNA sense strand
aacucuuauuaagagucacaa

SEQ ID NO: 27673 - RNA, 21 nt, Artificial Sequence
  Marburg virus siRNA sense strand
acucuuauuaagagucacaac

SEQ ID NO: 27674 - RNA, 21 nt, Artificial Sequence
  Marburg virus siRNA sense strand
cucuuauuaagagucacaacc

SEQ ID NO: 27675 - RNA, 21 nt, Artificial Sequence
  Marburg virus siRNA sense strand
ucuuauuaagagucacaaccg

SEQ ID NO: 27676 - RNA, 21 nt, Artificial Sequence
  Marburg virus siRNA sense strand
cuuauuaagagucacaaccga

SEQ ID NO: 27677 - RNA, 21 nt, Artificial Sequence
  Marburg virus siRNA sense strand
uuauuaagagucacaaccgag

SEQ ID NO: 27678 - RNA, 21 nt, Artificial Sequence
  Marburg virus siRNA sense strand
uauuaagagucacaaccgagg

SEQ ID NO: 27679 - RNA, 21 nt, Artificial Sequence
  Marburg virus siRNA sense strand
auuaagagucacaaccgagga

SEQ ID NO: 27680 - RNA, 21 nt, Artificial Sequence
  Marburg virus siRNA sense strand
uuaagagucacaaccgaggaa

SEQ ID NO: 27681 - RNA, 21 nt, Artificial Sequence
  Marburg virus siRNA sense strand
uaagagucacaaccgaggaaa

SEQ ID NO: 27682 - RNA, 21 nt, Artificial Sequence
  Marburg virus siRNA sense strand
aagagucacaaccgaggaaag

SEQ ID NO: 27683 - RNA, 21 nt, Artificial Sequence
  Marburg virus siRNA sense strand
agagucacaaccgaggaaagg

SEQ ID NO: 27684 - RNA, 21 nt, Artificial Sequence
  Marburg virus siRNA sense strand
gagucacaaccgaggaaagga

SEQ ID NO: 27685 - RNA, 21 nt, Artificial Sequence
  Marburg virus siRNA sense strand
agucacaaccgaggaaaggac

SEQ ID NO: 27686 - RNA, 21 nt, Artificial Sequence
  Marburg virus siRNA sense strand
gucacaaccgaggaaaggaca

SEQ ID NO: 27687 - RNA, 21 nt, Artificial Sequence
  Marburg virus siRNA sense strand
ucacaaccgaggaaaggacau

SEQ ID NO: 27688 - RNA, 21 nt, Artificial Sequence
  Marburg virus siRNA sense strand
cacaaccgaggaaaggacauu

SEQ ID NO: 27689 - RNA, 21 nt, Artificial Sequence
  Marburg virus siRNA sense strand
acaaccgaggaaaggacauuu

SEQ ID NO: 27690 - RNA, 21 nt, Artificial Sequence
  Marburg virus siRNA sense strand
caaccgaggaaaggacauuuu

SEQ ID NO: 27691 - RNA, 21 nt, Artificial Sequence
  Marburg virus siRNA sense strand
aaccgaggaaaggacauuuuc

SEQ ID NO: 27692 - RNA, 21 nt, Artificial Sequence
  Marburg virus siRNA sense strand
accgaggaaaggacauuuucc

SEQ ID NO: 27693 - RNA, 21 nt, Artificial Sequence
  Marburg virus siRNA sense strand
ccgaggaaaggacauuuuccu

SEQ ID NO: 27694 - RNA, 21 nt, Artificial Sequence
  Marburg virus siRNA sense strand
cgaggaaaggacauuuuccuu

SEQ ID NO: 27695 - RNA, 21 nt, Artificial Sequence
  Marburg virus siRNA sense strand
gaggaaaggacauuuuccuua

SEQ ID NO: 27696 - RNA, 21 nt, Artificial Sequence
  Marburg virus siRNA sense strand
aggaaaggacauuuuccuuaa

SEQ ID NO: 27697 - RNA, 21 nt, Artificial Sequence
  Marburg virus siRNA sense strand
ggaaaggacauuuuccuuaau

SEQ ID NO: 27698 - RNA, 21 nt, Artificial Sequence
  Marburg virus siRNA sense strand
gaaaggacauuuuccuuaauu

SEQ ID NO: 27699 - RNA, 21 nt, Artificial Sequence
  Marburg virus siRNA sense strand
aaaggacauuuuccuuaauua

SEQ ID NO: 27700 - RNA, 21 nt, Artificial Sequence
  Marburg virus siRNA sense strand
aaggacauuuuccuuaauuaa

SEQ ID NO: 27701 - RNA, 21 nt, Artificial Sequence
  Marburg virus siRNA sense strand
aggacauuuuccuuaauuaau

SEQ ID NO: 27702 - RNA, 21 nt, Artificial Sequence
  Marburg virus siRNA sense strand
ggacauuuuccuuaauuaaua

SEQ ID NO: 27703 - RNA, 21 nt, Artificial Sequence
  Marburg virus siRNA sense strand
gacauuuuccuuaauuaauag

SEQ ID NO: 27704 - RNA, 21 nt, Artificial Sequence
  Marburg virus siRNA sense strand
acauuuuccuuaauuaauaga

SEQ ID NO: 27705 - RNA, 21 nt, Artificial Sequence
  Marburg virus siRNA sense strand
cauuuuccuuaauuaauagac

SEQ ID NO: 27706 - RNA, 21 nt, Artificial Sequence
  Marburg virus siRNA sense strand
auuuuccuuaauuaauagaca

SEQ ID NO: 27707 - RNA, 21 nt, Artificial Sequence
  Marburg virus siRNA sense strand
uuuuccuuaauuaauagacau

SEQ ID NO: 27708 - RNA, 21 nt, Artificial Sequence
  Marburg virus siRNA sense strand
uuuccuuaauuaauagacaug

SEQ ID NO: 27709 - RNA, 21 nt, Artificial Sequence
  Marburg virus siRNA sense strand
uuccuuaauuaauagacaugc

SEQ ID NO: 27710 - RNA, 21 nt, Artificial Sequence
  Marburg virus siRNA sense strand
uccuuaauuaauagacaugcc

SEQ ID NO: 27711 - RNA, 21 nt, Artificial Sequence
  Marburg virus siRNA sense strand
ccuuaauuaauagacaugcca

SEQ ID NO: 27712 - RNA, 21 nt, Artificial Sequence
  Marburg virus siRNA sense strand
cuuaauuaauagacaugccau

SEQ ID NO: 27713 - RNA, 21 nt, Artificial Sequence
  Marburg virus siRNA sense strand
uuaauuaauagacaugccauu

SEQ ID NO: 27714 - RNA, 21 nt, Artificial Sequence
  Marburg virus siRNA sense strand
uaauuaauagacaugccauug

SEQ ID NO: 27715 - RNA, 21 nt, Artificial Sequence
  Marburg virus siRNA sense strand
aauuaauagacaugccauuga

SEQ ID NO: 27716 - RNA, 21 nt, Artificial Sequence
  Marburg virus siRNA sense strand
auuaauagacaugccauugac

SEQ ID NO: 27717 - RNA, 21 nt, Artificial Sequence
  Marburg virus siRNA sense strand
uuaauagacaugccauugacu

SEQ ID NO: 27718 - RNA, 21 nt, Artificial Sequence
  Marburg virus siRNA sense strand
uaauagacaugccauugacuu

SEQ ID NO: 27719 - RNA, 21 nt, Artificial Sequence
  Marburg virus siRNA sense strand
aauagacaugccauugacuuu

SEQ ID NO: 27720 - RNA, 21 nt, Artificial Sequence
  Marburg virus siRNA sense strand
auagacaugccauugacuuuc

SEQ ID NO: 27721 - RNA, 21 nt, Artificial Sequence
  Marburg virus siRNA sense strand
uagacaugccauugacuuucu

SEQ ID NO: 27722 - RNA, 21 nt, Artificial Sequence
  Marburg virus siRNA sense strand
agacaugccauugacuuucua

SEQ ID NO: 27723 - RNA, 21 nt, Artificial Sequence
  Marburg virus siRNA sense strand
gacaugccauugacuuucuac

SEQ ID NO: 27724 - RNA, 21 nt, Artificial Sequence
  Marburg virus siRNA sense strand
acaugccauugacuuucuacu

SEQ ID NO: 27725 - RNA, 21 nt, Artificial Sequence
  Marburg virus siRNA sense strand
caugccauugacuuucuacuc

SEQ ID NO: 27726 - RNA, 21 nt, Artificial Sequence
  Marburg virus siRNA sense strand
augccauugacuuucuacuca

SEQ ID NO: 27727 - RNA, 21 nt, Artificial Sequence
  Marburg virus siRNA sense strand
ugccauugacuuucuacucac

SEQ ID NO: 27728 - RNA, 21 nt, Artificial Sequence
  Marburg virus siRNA sense strand
gccauugacuuucuacucaca

SEQ ID NO: 27729 - RNA, 21 nt, Artificial Sequence
  Marburg virus siRNA sense strand
ccauugacuuucuacucacaa

SEQ ID NO: 27730 - RNA, 21 nt, Artificial Sequence
  Marburg virus siRNA sense strand
cauugacuuucuacucacaag

SEQ ID NO: 27731 - RNA, 21 nt, Artificial Sequence
  Marburg virus siRNA sense strand
auugacuuucuacucacaagg

SEQ ID NO: 27732 - RNA, 21 nt, Artificial Sequence
  Marburg virus siRNA sense strand
uugacuuucuacucacaaggu

SEQ ID NO: 27733 - RNA, 21 nt, Artificial Sequence
  Marburg virus siRNA sense strand
ugacuuucuacucacaaggug

SEQ ID NO: 27734 - RNA, 21 nt, Artificial Sequence
  Marburg virus siRNA sense strand
gacuuucuacucacaaggugg

SEQ ID NO: 27735 - RNA, 21 nt, Artificial Sequence
  Marburg virus siRNA sense strand
acuuucuacucacaagguggg

SEQ ID NO: 27736 - RNA, 21 nt, Artificial Sequence
  Marburg virus siRNA sense strand
cuuucuacucacaaggugggg

SEQ ID NO: 27737 - RNA, 21 nt, Artificial Sequence
  Marburg virus siRNA sense strand
uuucuacucacaaggugggga

SEQ ID NO: 27738 - RNA, 21 nt, Artificial Sequence
  Marburg virus siRNA sense strand
uucuacucacaagguggggag

SEQ ID NO: 27739 - RNA, 21 nt, Artificial Sequence
  Marburg virus siRNA sense strand
ucuacucacaagguggggagg

SEQ ID NO: 27740 - RNA, 21 nt, Artificial Sequence
  Marburg virus siRNA sense strand
cuacucacaagguggggagga

SEQ ID NO: 27741 - RNA, 21 nt, Artificial Sequence
  Marburg virus siRNA sense strand
uacucacaagguggggaggaa

SEQ ID NO: 27742 - RNA, 21 nt, Artificial Sequence
  Marburg virus siRNA sense strand
acucacaagguggggaggaac

SEQ ID NO: 27743 - RNA, 21 nt, Artificial Sequence
  Marburg virus siRNA sense strand
cucacaagguggggaggaaca

SEQ ID NO: 27744 - RNA, 21 nt, Artificial Sequence
  Marburg virus siRNA sense strand
ucacaagguggggaggaacau

SEQ ID NO: 27745 - RNA, 21 nt, Artificial Sequence
  Marburg virus siRNA sense strand
cacaagguggggaggaacaug

SEQ ID NO: 27746 - RNA, 21 nt, Artificial Sequence
  Marburg virus siRNA sense strand
acaagguggggaggaacaugc

SEQ ID NO: 27747 - RNA, 21 nt, Artificial Sequence
  Marburg virus siRNA sense strand
caagguggggaggaacaugca

SEQ ID NO: 27748 - RNA, 21 nt, Artificial Sequence
  Marburg virus siRNA sense strand
aagguggggaggaacaugcaa

SEQ ID NO: 27749 - RNA, 21 nt, Artificial Sequence
  Marburg virus siRNA sense strand
agguggggaggaacaugcaaa

SEQ ID NO: 27750 - RNA, 21 nt, Artificial Sequence
  Marburg virus siRNA sense strand
gguggggaggaacaugcaaag

SEQ ID NO: 27751 - RNA, 21 nt, Artificial Sequence
  Marburg virus siRNA sense strand
guggggaggaacaugcaaagu

SEQ ID NO: 27752 - RNA, 21 nt, Artificial Sequence
  Marburg virus siRNA sense strand
uggggaggaacaugcaaagug

SEQ ID NO: 27753 - RNA, 21 nt, Artificial Sequence
  Marburg virus siRNA sense strand
ggggaggaacaugcaaagugc

SEQ ID NO: 27754 - RNA, 21 nt, Artificial Sequence
  Marburg virus siRNA sense strand
gggaggaacaugcaaagugcu

SEQ ID NO: 27755 - RNA, 21 nt, Artificial Sequence
  Marburg virus siRNA sense strand
ggaggaacaugcaaagugcuu

SEQ ID NO: 27756 - RNA, 21 nt, Artificial Sequence
  Marburg virus siRNA sense strand
gaggaacaugcaaagugcuug

SEQ ID NO: 27757 - RNA, 21 nt, Artificial Sequence
  Marburg virus siRNA sense strand
aggaacaugcaaagugcuugg

SEQ ID NO: 27758 - RNA, 21 nt, Artificial Sequence
  Marburg virus siRNA sense strand
ggaacaugcaaagugcuugga

SEQ ID NO: 27759 - RNA, 21 nt, Artificial Sequence
  Marburg virus siRNA sense strand
gaacaugcaaagugcuuggac

SEQ ID NO: 27760 - RNA, 21 nt, Artificial Sequence
  Marburg virus siRNA sense strand
aacaugcaaagugcuuggacc

SEQ ID NO: 27761 - RNA, 21 nt, Artificial Sequence
  Marburg virus siRNA sense strand
acaugcaaagugcuuggaccu

SEQ ID NO: 27762 - RNA, 21 nt, Artificial Sequence
  Marburg virus siRNA sense strand
caugcaaagugcuuggaccug

SEQ ID NO: 27763 - RNA, 21 nt, Artificial Sequence
  Marburg virus siRNA sense strand
augcaaagugcuuggaccuga

SEQ ID NO: 27764 - RNA, 21 nt, Artificial Sequence
  Marburg virus siRNA sense strand
ugcaaagugcuuggaccugau

SEQ ID NO: 27765 - RNA, 21 nt, Artificial Sequence
  Marburg virus siRNA sense strand
gcaaagugcuuggaccugauu

SEQ ID NO: 27766 - RNA, 21 nt, Artificial Sequence
  Marburg virus siRNA sense strand
caaagugcuuggaccugauug

SEQ ID NO: 27767 - RNA, 21 nt, Artificial Sequence
  Marburg virus siRNA sense strand
aaagugcuuggaccugauugu

SEQ ID NO: 27768 - RNA, 21 nt, Artificial Sequence
  Marburg virus siRNA sense strand
aagugcuuggaccugauuguu

SEQ ID NO: 27769 - RNA, 21 nt, Artificial Sequence
  Marburg virus siRNA sense strand
agugcuuggaccugauuguug

SEQ ID NO: 27770 - RNA, 21 nt, Artificial Sequence
  Marburg virus siRNA sense strand
gugcuuggaccugauuguugc

SEQ ID NO: 27771 - RNA, 21 nt, Artificial Sequence
  Marburg virus siRNA sense strand
ugcuuggaccugauuguugca

SEQ ID NO: 27772 - RNA, 21 nt, Artificial Sequence
  Marburg virus siRNA sense strand
gcuuggaccugauuguugcau

SEQ ID NO: 27773 - RNA, 21 nt, Artificial Sequence
  Marburg virus siRNA sense strand
cuuggaccugauuguugcauu

SEQ ID NO: 27774 - RNA, 21 nt, Artificial Sequence
  Marburg virus siRNA sense strand
uuggaccugauuguugcauug

SEQ ID NO: 27775 - RNA, 21 nt, Artificial Sequence
  Marburg virus siRNA sense strand
uggaccugauuguugcauugg

SEQ ID NO: 27776 - RNA, 21 nt, Artificial Sequence
  Marburg virus siRNA sense strand
ggaccugauuguugcauugga

SEQ ID NO: 27777 - RNA, 21 nt, Artificial Sequence
  Marburg virus siRNA sense strand
gaccugauuguugcauuggaa

SEQ ID NO: 27778 - RNA, 21 nt, Artificial Sequence
  Marburg virus siRNA sense strand
accugauuguugcauuggaau

SEQ ID NO: 27779 - RNA, 21 nt, Artificial Sequence
  Marburg virus siRNA sense strand
ccugauuguugcauuggaaua

SEQ ID NO: 27780 - RNA, 21 nt, Artificial Sequence
  Marburg virus siRNA sense strand
cugauuguugcauuggaauag

SEQ ID NO: 27781 - RNA, 21 nt, Artificial Sequence
  Marburg virus siRNA sense strand
ugauuguugcauuggaauaga

SEQ ID NO: 27782 - RNA, 21 nt, Artificial Sequence
  Marburg virus siRNA sense strand
gauuguugcauuggaauagaa

SEQ ID NO: 27783 - RNA, 21 nt, Artificial Sequence
  Marburg virus siRNA sense strand
auuguugcauuggaauagaag

SEQ ID NO: 27784 - RNA, 21 nt, Artificial Sequence
  Marburg virus siRNA sense strand
uuguugcauuggaauagaaga

SEQ ID NO: 27785 - RNA, 21 nt, Artificial Sequence
  Marburg virus siRNA sense strand
uguugcauuggaauagaagac

SEQ ID NO: 27786 - RNA, 21 nt, Artificial Sequence
  Marburg virus siRNA sense strand
guugcauuggaauagaagacu

SEQ ID NO: 27787 - RNA, 21 nt, Artificial Sequence
  Marburg virus siRNA sense strand
uugcauuggaauagaagacuu

SEQ ID NO: 27788 - RNA, 21 nt, Artificial Sequence
  Marburg virus siRNA sense strand
ugcauuggaauagaagacuug

SEQ ID NO: 27789 - RNA, 21 nt, Artificial Sequence
  Marburg virus siRNA sense strand
gcauuggaauagaagacuugu

SEQ ID NO: 27790 - RNA, 21 nt, Artificial Sequence
  Marburg virus siRNA sense strand
cauuggaauagaagacuuguc

SEQ ID NO: 27791 - RNA, 21 nt, Artificial Sequence
  Marburg virus siRNA sense strand
auuggaauagaagacuugucc

SEQ ID NO: 27792 - RNA, 21 nt, Artificial Sequence
  Marburg virus siRNA sense strand
uuggaauagaagacuugucca

SEQ ID NO: 27793 - RNA, 21 nt, Artificial Sequence
  Marburg virus siRNA sense strand
uggaauagaagacuuguccag

SEQ ID NO: 27794 - RNA, 21 nt, Artificial Sequence
  Marburg virus siRNA sense strand
ggaauagaagacuuguccagg

SEQ ID NO: 27795 - RNA, 21 nt, Artificial Sequence
  Marburg virus siRNA sense strand
gaauagaagacuuguccagga

SEQ ID NO: 27796 - RNA, 21 nt, Artificial Sequence
  Marburg virus siRNA sense strand
aauagaagacuuguccaggaa

SEQ ID NO: 27797 - RNA, 21 nt, Artificial Sequence
  Marburg virus siRNA sense strand
auagaagacuuguccaggaau

SEQ ID NO: 27798 - RNA, 21 nt, Artificial Sequence
  Marburg virus siRNA sense strand
uagaagacuuguccaggaaua

SEQ ID NO: 27799 - RNA, 21 nt, Artificial Sequence
  Marburg virus siRNA sense strand
agaagacuuguccaggaauau

SEQ ID NO: 27800 - RNA, 21 nt, Artificial Sequence
  Marburg virus siRNA sense strand
gaagacuuguccaggaauauu

SEQ ID NO: 27801 - RNA, 21 nt, Artificial Sequence
  Marburg virus siRNA sense strand
aagacuuguccaggaauauuu

SEQ ID NO: 27802 - RNA, 21 nt, Artificial Sequence
  Marburg virus siRNA sense strand
agacuuguccaggaauauuuc

SEQ ID NO: 27803 - RNA, 21 nt, Artificial Sequence
  Marburg virus siRNA sense strand
gacuuguccaggaauauuucg

SEQ ID NO: 27804 - RNA, 21 nt, Artificial Sequence
  Marburg virus siRNA sense strand
acuuguccaggaauauuucgg

SEQ ID NO: 27805 - RNA, 21 nt, Artificial Sequence
  Marburg virus siRNA sense strand
cuuguccaggaauauuucgga

SEQ ID NO: 27806 - RNA, 21 nt, Artificial Sequence
  Marburg virus siRNA sense strand
uuguccaggaauauuucggaa

SEQ ID NO: 27807 - RNA, 21 nt, Artificial Sequence
  Marburg virus siRNA sense strand
uguccaggaauauuucggaac

SEQ ID NO: 27808 - RNA, 21 nt, Artificial Sequence
  Marburg virus siRNA sense strand
guccaggaauauuucggaaca

SEQ ID NO: 27809 - RNA, 21 nt, Artificial Sequence
  Marburg virus siRNA sense strand
uccaggaauauuucggaacaa

SEQ ID NO: 27810 - RNA, 21 nt, Artificial Sequence
  Marburg virus siRNA sense strand
ccaggaauauuucggaacaaa

SEQ ID NO: 27811 - RNA, 21 nt, Artificial Sequence
  Marburg virus siRNA sense strand
caggaauauuucggaacaaau

SEQ ID NO: 27812 - RNA, 21 nt, Artificial Sequence
  Marburg virus siRNA sense strand
aggaauauuucggaacaaauu

SEQ ID NO: 27813 - RNA, 21 nt, Artificial Sequence
  Marburg virus siRNA sense strand
ggaauauuucggaacaaauug

SEQ ID NO: 27814 - RNA, 21 nt, Artificial Sequence
  Marburg virus siRNA sense strand
gaauauuucggaacaaauuga

SEQ ID NO: 27815 - RNA, 21 nt, Artificial Sequence
  Marburg virus siRNA sense strand
aauauuucggaacaaauugac

SEQ ID NO: 27816 - RNA, 21 nt, Artificial Sequence
  Marburg virus siRNA sense strand
auauuucggaacaaauugacc

SEQ ID NO: 27817 - RNA, 21 nt, Artificial Sequence
  Marburg virus siRNA sense strand
uauuucggaacaaauugacca

SEQ ID NO: 27818 - RNA, 21 nt, Artificial Sequence
  Marburg virus siRNA sense strand
auuucggaacaaauugaccaa

SEQ ID NO: 27819 - RNA, 21 nt, Artificial Sequence
  Marburg virus siRNA sense strand
uuucggaacaaauugaccaaa

SEQ ID NO: 27820 - RNA, 21 nt, Artificial Sequence
  Marburg virus siRNA sense strand
uucggaacaaauugaccaaau

SEQ ID NO: 27821 - RNA, 21 nt, Artificial Sequence
  Marburg virus siRNA sense strand
ucggaacaaauugaccaaauc

SEQ ID NO: 27822 - RNA, 21 nt, Artificial Sequence
  Marburg virus siRNA sense strand
cggaacaaauugaccaaauca

SEQ ID NO: 27823 - RNA, 21 nt, Artificial Sequence
  Marburg virus siRNA sense strand
ggaacaaauugaccaaaucaa

SEQ ID NO: 27824 - RNA, 21 nt, Artificial Sequence
  Marburg virus siRNA sense strand
gaacaaauugaccaaaucaaa

SEQ ID NO: 27825 - RNA, 21 nt, Artificial Sequence
  Marburg virus siRNA sense strand
aacaaauugaccaaaucaaaa

SEQ ID NO: 27826 - RNA, 21 nt, Artificial Sequence
  Marburg virus siRNA sense strand
acaaauugaccaaaucaaaaa

SEQ ID NO: 27827 - RNA, 21 nt, Artificial Sequence
  Marburg virus siRNA sense strand
caaauugaccaaaucaaaaaa

SEQ ID NO: 27828 - RNA, 21 nt, Artificial Sequence
  Marburg virus siRNA sense strand
aaauugaccaaaucaaaaaag

SEQ ID NO: 27829 - RNA, 21 nt, Artificial Sequence
  Marburg virus siRNA sense strand
aauugaccaaaucaaaaaaga

SEQ ID NO: 27830 - RNA, 21 nt, Artificial Sequence
  Marburg virus siRNA sense strand
auugaccaaaucaaaaaagau

SEQ ID NO: 27831 - RNA, 21 nt, Artificial Sequence
  Marburg virus siRNA sense strand
uugaccaaaucaaaaaagaug

SEQ ID NO: 27832 - RNA, 21 nt, Artificial Sequence
  Marburg virus siRNA sense strand
ugaccaaaucaaaaaagauga

SEQ ID NO: 27833 - RNA, 21 nt, Artificial Sequence
  Marburg virus siRNA sense strand
gaccaaaucaaaaaagaugaa

SEQ ID NO: 27834 - RNA, 21 nt, Artificial Sequence
  Marburg virus siRNA sense strand
accaaaucaaaaaagaugaac

SEQ ID NO: 27835 - RNA, 21 nt, Artificial Sequence
  Marburg virus siRNA sense strand
ccaaaucaaaaaagaugaaca

SEQ ID NO: 27836 - RNA, 21 nt, Artificial Sequence
  Marburg virus siRNA sense strand
caaaucaaaaaagaugaacaa

SEQ ID NO: 27837 - RNA, 21 nt, Artificial Sequence
  Marburg virus siRNA sense strand
aaaucaaaaaagaugaacaaa

SEQ ID NO: 27838 - RNA, 21 nt, Artificial Sequence
  Marburg virus siRNA sense strand
aaucaaaaaagaugaacaaaa

SEQ ID NO: 27839 - RNA, 21 nt, Artificial Sequence
  Marburg virus siRNA sense strand
aucaaaaaagaugaacaaaaa

SEQ ID NO: 27840 - RNA, 21 nt, Artificial Sequence
  Marburg virus siRNA sense strand
ucaaaaaagaugaacaaaaag

SEQ ID NO: 27841 - RNA, 21 nt, Artificial Sequence
  Marburg virus siRNA sense strand
caaaaaagaugaacaaaaaga

SEQ ID NO: 27842 - RNA, 21 nt, Artificial Sequence
  Marburg virus siRNA sense strand
aaaaaagaugaacaaaaagag

SEQ ID NO: 27843 - RNA, 21 nt, Artificial Sequence
  Marburg virus siRNA sense strand
aaaaagaugaacaaaaagagg

SEQ ID NO: 27844 - RNA, 21 nt, Artificial Sequence
  Marburg virus siRNA sense strand
aaaagaugaacaaaaagaggg

SEQ ID NO: 27845 - RNA, 21 nt, Artificial Sequence
  Marburg virus siRNA sense strand
aaagaugaacaaaaagagggg

SEQ ID NO: 27846 - RNA, 21 nt, Artificial Sequence
  Marburg virus siRNA sense strand
aagaugaacaaaaagagggga

SEQ ID NO: 27847 - RNA, 21 nt, Artificial Sequence
  Marburg virus siRNA sense strand
agaugaacaaaaagaggggac

SEQ ID NO: 27848 - RNA, 21 nt, Artificial Sequence
  Marburg virus siRNA sense strand
gaugaacaaaaagaggggacu

SEQ ID NO: 27849 - RNA, 21 nt, Artificial Sequence
  Marburg virus siRNA sense strand
augaacaaaaagaggggacug

SEQ ID NO: 27850 - RNA, 21 nt, Artificial Sequence
  Marburg virus siRNA sense strand
ugaacaaaaagaggggacugg

SEQ ID NO: 27851 - RNA, 21 nt, Artificial Sequence
  Marburg virus siRNA sense strand
gaacaaaaagaggggacuggu

SEQ ID NO: 27852 - RNA, 21 nt, Artificial Sequence
  Marburg virus siRNA sense strand
aacaaaaagaggggacugguu

SEQ ID NO: 27853 - RNA, 21 nt, Artificial Sequence
  Marburg virus siRNA sense strand
acaaaaagaggggacugguug

SEQ ID NO: 27854 - RNA, 21 nt, Artificial Sequence
  Marburg virus siRNA sense strand
caaaaagaggggacugguugg

SEQ ID NO: 27855 - RNA, 21 nt, Artificial Sequence
  Marburg virus siRNA sense strand
aaaaagaggggacugguuggg

SEQ ID NO: 27856 - RNA, 21 nt, Artificial Sequence
  Marburg virus siRNA sense strand
aaaagaggggacugguugggg

SEQ ID NO: 27857 - RNA, 21 nt, Artificial Sequence
  Marburg virus siRNA sense strand
aaagaggggacugguuggggu

SEQ ID NO: 27858 - RNA, 21 nt, Artificial Sequence
  Marburg virus siRNA sense strand
aagaggggacugguugggguc

SEQ ID NO: 27859 - RNA, 21 nt, Artificial Sequence
  Marburg virus siRNA sense strand
agaggggacugguuggggucu

SEQ ID NO: 27860 - RNA, 21 nt, Artificial Sequence
  Marburg virus siRNA sense strand
gaggggacugguuggggucua

SEQ ID NO: 27861 - RNA, 21 nt, Artificial Sequence
  Marburg virus siRNA sense strand
aggggacugguuggggucuag

SEQ ID NO: 27862 - RNA, 21 nt, Artificial Sequence
  Marburg virus siRNA sense strand
ggggacugguuggggucuagg

SEQ ID NO: 27863 - RNA, 21 nt, Artificial Sequence
  Marburg virus siRNA sense strand
gggacugguuggggucuaggu

SEQ ID NO: 27864 - RNA, 21 nt, Artificial Sequence
  Marburg virus siRNA sense strand
ggacugguuggggucuaggug

SEQ ID NO: 27865 - RNA, 21 nt, Artificial Sequence
  Marburg virus siRNA sense strand
gacugguuggggucuaggugg

SEQ ID NO: 27866 - RNA, 21 nt, Artificial Sequence
  Marburg virus siRNA sense strand
acugguuggggucuagguggu

SEQ ID NO: 27867 - RNA, 21 nt, Artificial Sequence
  Marburg virus siRNA sense strand
cugguuggggucuagguggua

SEQ ID NO: 27868 - RNA, 21 nt, Artificial Sequence
  Marburg virus siRNA sense strand
ugguuggggucuaggugguaa

SEQ ID NO: 27869 - RNA, 21 nt, Artificial Sequence
  Marburg virus siRNA sense strand
gguuggggucuaggugguaaa

SEQ ID NO: 27870 - RNA, 21 nt, Artificial Sequence
  Marburg virus siRNA sense strand
guuggggucuaggugguaaau

SEQ ID NO: 27871 - RNA, 21 nt, Artificial Sequence
  Marburg virus siRNA sense strand
uuggggucuaggugguaaaug

SEQ ID NO: 27872 - RNA, 21 nt, Artificial Sequence
  Marburg virus siRNA sense strand
uggggucuaggugguaaaugg

SEQ ID NO: 27873 - RNA, 21 nt, Artificial Sequence
  Marburg virus siRNA sense strand
ggggucuaggugguaaauggu

SEQ ID NO: 27874 - RNA, 21 nt, Artificial Sequence
  Marburg virus siRNA sense strand
gggucuaggugguaaauggug

SEQ ID NO: 27875 - RNA, 21 nt, Artificial Sequence
  Marburg virus siRNA sense strand
ggucuaggugguaaauggugg

SEQ ID NO: 27876 - RNA, 21 nt, Artificial Sequence
  Marburg virus siRNA sense strand
gucuaggugguaaauggugga

SEQ ID NO: 27877 - RNA, 21 nt, Artificial Sequence
  Marburg virus siRNA sense strand
ucuaggugguaaaugguggac

SEQ ID NO: 27878 - RNA, 21 nt, Artificial Sequence
  Marburg virus siRNA sense strand
cuaggugguaaaugguggaca

SEQ ID NO: 27879 - RNA, 21 nt, Artificial Sequence
  Marburg virus siRNA sense strand
uaggugguaaaugguggacau

SEQ ID NO: 27880 - RNA, 21 nt, Artificial Sequence
  Marburg virus siRNA sense strand
aggugguaaaugguggacauc

SEQ ID NO: 27881 - RNA, 21 nt, Artificial Sequence
  Marburg virus siRNA sense strand
ggugguaaaugguggacaucc

SEQ ID NO: 27882 - RNA, 21 nt, Artificial Sequence
  Marburg virus siRNA sense strand
gugguaaaugguggacauccg

SEQ ID NO: 27883 - RNA, 21 nt, Artificial Sequence
  Marburg virus siRNA sense strand
ugguaaaugguggacauccga

SEQ ID NO: 27884 - RNA, 21 nt, Artificial Sequence
  Marburg virus siRNA sense strand
gguaaaugguggacauccgac

SEQ ID NO: 27885 - RNA, 21 nt, Artificial Sequence
  Marburg virus siRNA sense strand
guaaaugguggacauccgacu

SEQ ID NO: 27886 - RNA, 21 nt, Artificial Sequence
  Marburg virus siRNA sense strand
uaaaugguggacauccgacug

SEQ ID NO: 27887 - RNA, 21 nt, Artificial Sequence
  Marburg virus siRNA sense strand
aaaugguggacauccgacugg

SEQ ID NO: 27888 - RNA, 21 nt, Artificial Sequence
  Marburg virus siRNA sense strand
aaugguggacauccgacuggg

SEQ ID NO: 27889 - RNA, 21 nt, Artificial Sequence
  Marburg virus siRNA sense strand
augguggacauccgacugggg

SEQ ID NO: 27890 - RNA, 21 nt, Artificial Sequence
  Marburg virus siRNA sense strand
ugguggacauccgacuggggu

SEQ ID NO: 27891 - RNA, 21 nt, Artificial Sequence
  Marburg virus siRNA sense strand
gguggacauccgacuggggug

SEQ ID NO: 27892 - RNA, 21 nt, Artificial Sequence
  Marburg virus siRNA sense strand
guggacauccgacuggggugu

SEQ ID NO: 27893 - RNA, 21 nt, Artificial Sequence
  Marburg virus siRNA sense strand
uggacauccgacugggguguu

SEQ ID NO: 27894 - RNA, 21 nt, Artificial Sequence
  Marburg virus siRNA sense strand
ggacauccgacugggguguuc

SEQ ID NO: 27895 - RNA, 21 nt, Artificial Sequence
  Marburg virus siRNA sense strand
gacauccgacugggguguucu

SEQ ID NO: 27896 - RNA, 21 nt, Artificial Sequence
  Marburg virus siRNA sense strand
acauccgacugggguguucuu

SEQ ID NO: 27897 - RNA, 21 nt, Artificial Sequence
  Marburg virus siRNA sense strand
cauccgacugggguguucuua

SEQ ID NO: 27898 - RNA, 21 nt, Artificial Sequence
  Marburg virus siRNA sense strand
auccgacugggguguucuuac

SEQ ID NO: 27899 - RNA, 21 nt, Artificial Sequence
  Marburg virus siRNA sense strand
uccgacugggguguucuuacu

SEQ ID NO: 27900 - RNA, 21 nt, Artificial Sequence
  Marburg virus siRNA sense strand
ccgacugggguguucuuacua

SEQ ID NO: 27901 - RNA, 21 nt, Artificial Sequence
  Marburg virus siRNA sense strand
cgacugggguguucuuacuaa

SEQ ID NO: 27902 - RNA, 21 nt, Artificial Sequence
  Marburg virus siRNA sense strand
gacugggguguucuuacuaac

SEQ ID NO: 27903 - RNA, 21 nt, Artificial Sequence
  Marburg virus siRNA sense strand
acugggguguucuuacuaacu

SEQ ID NO: 27904 - RNA, 21 nt, Artificial Sequence
  Marburg virus siRNA sense strand
cugggguguucuuacuaacuu

SEQ ID NO: 27905 - RNA, 21 nt, Artificial Sequence
  Marburg virus siRNA sense strand
ugggguguucuuacuaacuug

SEQ ID NO: 27906 - RNA, 21 nt, Artificial Sequence
  Marburg virus siRNA sense strand
gggguguucuuacuaacuugg

SEQ ID NO: 27907 - RNA, 21 nt, Artificial Sequence
  Marburg virus siRNA sense strand
ggguguucuuacuaacuuggg

SEQ ID NO: 27908 - RNA, 21 nt, Artificial Sequence
  Marburg virus siRNA sense strand
gguguucuuacuaacuugggc

SEQ ID NO: 27909 - RNA, 21 nt, Artificial Sequence
  Marburg virus siRNA sense strand
guguucuuacuaacuugggca

SEQ ID NO: 27910 - RNA, 21 nt, Artificial Sequence
  Marburg virus siRNA sense strand
uguucuuacuaacuugggcau

SEQ ID NO: 27911 - RNA, 21 nt, Artificial Sequence
  Marburg virus siRNA sense strand
guucuuacuaacuugggcauu

SEQ ID NO: 27912 - RNA, 21 nt, Artificial Sequence
  Marburg virus siRNA sense strand
uucuuacuaacuugggcauuu

SEQ ID NO: 27913 - RNA, 21 nt, Artificial Sequence
  Marburg virus siRNA sense strand
ucuuacuaacuugggcauuuu

SEQ ID NO: 27914 - RNA, 21 nt, Artificial Sequence
  Marburg virus siRNA sense strand
cuuacuaacuugggcauuuug

SEQ ID NO: 27915 - RNA, 21 nt, Artificial Sequence
  Marburg virus siRNA sense strand
uuacuaacuugggcauuuugc

SEQ ID NO: 27916 - RNA, 21 nt, Artificial Sequence
  Marburg virus siRNA sense strand
uacuaacuugggcauuuugcu

SEQ ID NO: 27917 - RNA, 21 nt, Artificial Sequence
  Marburg virus siRNA sense strand
acuaacuugggcauuuugcua

SEQ ID NO: 27918 - RNA, 21 nt, Artificial Sequence
  Marburg virus siRNA sense strand
cuaacuugggcauuuugcuac

SEQ ID NO: 27919 - RNA, 21 nt, Artificial Sequence
  Marburg virus siRNA sense strand
uaacuugggcauuuugcuacu

SEQ ID NO: 27920 - RNA, 21 nt, Artificial Sequence
  Marburg virus siRNA sense strand
aacuugggcauuuugcuacua

SEQ ID NO: 27921 - RNA, 21 nt, Artificial Sequence
  Marburg virus siRNA sense strand
acuugggcauuuugcuacuau

SEQ ID NO: 27922 - RNA, 21 nt, Artificial Sequence
  Marburg virus siRNA sense strand
cuugggcauuuugcuacuauu

SEQ ID NO: 27923 - RNA, 21 nt, Artificial Sequence
  Marburg virus siRNA sense strand
uugggcauuuugcuacuauua

SEQ ID NO: 27924 - RNA, 21 nt, Artificial Sequence
  Marburg virus siRNA sense strand
ugggcauuuugcuacuauuau

SEQ ID NO: 27925 - RNA, 21 nt, Artificial Sequence
  Marburg virus siRNA sense strand
gggcauuuugcuacuauuauc

SEQ ID NO: 27926 - RNA, 21 nt, Artificial Sequence
  Marburg virus siRNA sense strand
ggcauuuugcuacuauuaucc

SEQ ID NO: 27927 - RNA, 21 nt, Artificial Sequence
  Marburg virus siRNA sense strand
gcauuuugcuacuauuaucca

SEQ ID NO: 27928 - RNA, 21 nt, Artificial Sequence
  Marburg virus siRNA sense strand
cauuuugcuacuauuauccau

SEQ ID NO: 27929 - RNA, 21 nt, Artificial Sequence
  Marburg virus siRNA sense strand
auuuugcuacuauuauccaua

SEQ ID NO: 27930 - RNA, 21 nt, Artificial Sequence
  Marburg virus siRNA sense strand
uuuugcuacuauuauccauag

SEQ ID NO: 27931 - RNA, 21 nt, Artificial Sequence
  Marburg virus siRNA sense strand
uuugcuacuauuauccauagc

SEQ ID NO: 27932 - RNA, 21 nt, Artificial Sequence
  Marburg virus siRNA sense strand
uugcuacuauuauccauagcu

SEQ ID NO: 27933 - RNA, 21 nt, Artificial Sequence
  Marburg virus siRNA sense strand
ugcuacuauuauccauagcug

SEQ ID NO: 27934 - RNA, 21 nt, Artificial Sequence
  Marburg virus siRNA sense strand
gcuacuauuauccauagcugu

SEQ ID NO: 27935 - RNA, 21 nt, Artificial Sequence
  Marburg virus siRNA sense strand
cuacuauuauccauagcuguc

SEQ ID NO: 27936 - RNA, 21 nt, Artificial Sequence
  Marburg virus siRNA sense strand
uacuauuauccauagcugucu

SEQ ID NO: 27937 - RNA, 21 nt, Artificial Sequence
  Marburg virus siRNA sense strand
acuauuauccauagcugucuu

SEQ ID NO: 27938 - RNA, 21 nt, Artificial Sequence
  Marburg virus siRNA sense strand
cuauuauccauagcugucuug

SEQ ID NO: 27939 - RNA, 21 nt, Artificial Sequence
  Marburg virus siRNA sense strand
uauuauccauagcugucuuga

SEQ ID NO: 27940 - RNA, 21 nt, Artificial Sequence
  Marburg virus siRNA sense strand
auuauccauagcugucuugau

SEQ ID NO: 27941 - RNA, 21 nt, Artificial Sequence
  Marburg virus siRNA sense strand
uuauccauagcugucuugauu

SEQ ID NO: 27942 - RNA, 21 nt, Artificial Sequence
  Marburg virus siRNA sense strand
uauccauagcugucuugauug

SEQ ID NO: 27943 - RNA, 21 nt, Artificial Sequence
  Marburg virus siRNA sense strand
auccauagcugucuugauugc

SEQ ID NO: 27944 - RNA, 21 nt, Artificial Sequence
  Marburg virus siRNA sense strand
uccauagcugucuugauugcu

SEQ ID NO: 27945 - RNA, 21 nt, Artificial Sequence
  Marburg virus siRNA sense strand
ccauagcugucuugauugcuc

SEQ ID NO: 27946 - RNA, 21 nt, Artificial Sequence
  Marburg virus siRNA sense strand
cauagcugucuugauugcucu

SEQ ID NO: 27947 - RNA, 21 nt, Artificial Sequence
  Marburg virus siRNA sense strand
auagcugucuugauugcucua

SEQ ID NO: 27948 - RNA, 21 nt, Artificial Sequence
  Marburg virus siRNA sense strand
uagcugucuugauugcucuau

SEQ ID NO: 27949 - RNA, 21 nt, Artificial Sequence
  Marburg virus siRNA sense strand
agcugucuugauugcucuauc

SEQ ID NO: 27950 - RNA, 21 nt, Artificial Sequence
  Marburg virus siRNA sense strand
gcugucuugauugcucuaucc

SEQ ID NO: 27951 - RNA, 21 nt, Artificial Sequence
  Marburg virus siRNA sense strand
cugucuugauugcucuauccu

SEQ ID NO: 27952 - RNA, 21 nt, Artificial Sequence
  Marburg virus siRNA sense strand
ugucuugauugcucuauccug

SEQ ID NO: 27953 - RNA, 21 nt, Artificial Sequence
  Marburg virus siRNA sense strand
gucuugauugcucuauccugu

SEQ ID NO: 27954 - RNA, 21 nt, Artificial Sequence
  Marburg virus siRNA sense strand
ucuugauugcucuauccugua

SEQ ID NO: 27955 - RNA, 21 nt, Artificial Sequence
  Marburg virus siRNA sense strand
cuugauugcucuauccuguau

SEQ ID NO: 27956 - RNA, 21 nt, Artificial Sequence
  Marburg virus siRNA sense strand
uugauugcucuauccuguauu

SEQ ID NO: 27957 - RNA, 21 nt, Artificial Sequence
  Marburg virus siRNA sense strand
ugauugcucuauccuguauuu

SEQ ID NO: 27958 - RNA, 21 nt, Artificial Sequence
  Marburg virus siRNA sense strand
gauugcucuauccuguauuug

SEQ ID NO: 27959 - RNA, 21 nt, Artificial Sequence
  Marburg virus siRNA sense strand
auugcucuauccuguauuugu

SEQ ID NO: 27960 - RNA, 21 nt, Artificial Sequence
  Marburg virus siRNA sense strand
uugcucuauccuguauuuguc

SEQ ID NO: 27961 - RNA, 21 nt, Artificial Sequence
  Marburg virus siRNA sense strand
ugcucuauccuguauuugucg

SEQ ID NO: 27962 - RNA, 21 nt, Artificial Sequence
  Marburg virus siRNA sense strand
gcucuauccuguauuugucgu

SEQ ID NO: 27963 - RNA, 21 nt, Artificial Sequence
  Marburg virus siRNA sense strand
cucuauccuguauuugucgua

SEQ ID NO: 27964 - RNA, 21 nt, Artificial Sequence
  Marburg virus siRNA sense strand
ucuauccuguauuugucguau

SEQ ID NO: 27965 - RNA, 21 nt, Artificial Sequence
  Marburg virus siRNA sense strand
cuauccuguauuugucguauc

SEQ ID NO: 27966 - RNA, 21 nt, Artificial Sequence
  Marburg virus siRNA sense strand
uauccuguauuugucguaucu

SEQ ID NO: 27967 - RNA, 21 nt, Artificial Sequence
  Marburg virus siRNA sense strand
auccuguauuugucguaucuu

SEQ ID NO: 27968 - RNA, 21 nt, Artificial Sequence
  Marburg virus siRNA sense strand
uccuguauuugucguaucuuu

SEQ ID NO: 27969 - RNA, 21 nt, Artificial Sequence
  Marburg virus siRNA sense strand
ccuguauuugucguaucuuua

SEQ ID NO: 27970 - RNA, 21 nt, Artificial Sequence
  Marburg virus siRNA sense strand
cuguauuugucguaucuuuac

SEQ ID NO: 27971 - RNA, 21 nt, Artificial Sequence
  Marburg virus siRNA sense strand
uguauuugucguaucuuuacc

SEQ ID NO: 27972 - RNA, 21 nt, Artificial Sequence
  Marburg virus siRNA sense strand
guauuugucguaucuuuacca

SEQ ID NO: 27973 - RNA, 21 nt, Artificial Sequence
  Marburg virus siRNA sense strand
uauuugucguaucuuuaccaa

SEQ ID NO: 27974 - RNA, 21 nt, Artificial Sequence
  Marburg virus siRNA sense strand
auuugucguaucuuuaccaaa

SEQ ID NO: 27975 - RNA, 21 nt, Artificial Sequence
  Marburg virus siRNA sense strand
uuugucguaucuuuaccaaau

SEQ ID NO: 27976 - RNA, 21 nt, Artificial Sequence
  Marburg virus siRNA sense strand
uugucguaucuuuaccaaaua

SEQ ID NO: 27977 - RNA, 21 nt, Artificial Sequence
  Marburg virus siRNA sense strand
ugucguaucuuuaccaaauau

SEQ ID NO: 27978 - RNA, 21 nt, Artificial Sequence
  Marburg virus siRNA sense strand
gucguaucuuuaccaaauaua

SEQ ID NO: 27979 - RNA, 21 nt, Artificial Sequence
  Marburg virus siRNA sense strand
ucguaucuuuaccaaauauau

SEQ ID NO: 27980 - RNA, 21 nt, Artificial Sequence
  Marburg virus siRNA sense strand
cguaucuuuaccaaauauauc

SEQ ID NO: 27981 - RNA, 21 nt, Artificial Sequence
  Marburg virus siRNA sense strand
guaucuuuaccaaauauaucg

SEQ ID NO: 27982 - RNA, 21 nt, Artificial Sequence
  Marburg virus siRNA sense strand
uaucuuuaccaaauauaucgg

SEQ ID NO: 27983 - RNA, 21 nt, Artificial Sequence
  Marburg virus siRNA sense strand
aucuuuaccaaauauaucggg

SEQ ID NO: 27984 - RNA, 21 nt, Artificial Sequence
  Marburg virus siRNA sense strand
ucuuuaccaaauauaucgggu

SEQ ID NO: 27985 - RNA, 21 nt, Artificial Sequence
  Marburg virus siRNA sense strand
cuuuaccaaauauaucgggua

SEQ ID NO: 27986 - RNA, 21 nt, Artificial Sequence
  Marburg virus siRNA sense strand
uuuaccaaauauaucggguaa

SEQ ID NO: 27987 - RNA, 21 nt, Artificial Sequence
  Marburg virus siRNA sense strand
uuaccaaauauaucggguaau

SEQ ID NO: 27988 - RNA, 21 nt, Artificial Sequence
  Marburg virus siRNA sense strand
uaccaaauauaucggguaaua

SEQ ID NO: 27989 - RNA, 21 nt, Artificial Sequence
  Marburg virus siRNA sense strand
accaaauauaucggguaauau

SEQ ID NO: 27990 - RNA, 21 nt, Artificial Sequence
  Marburg virus siRNA sense strand
ccaaauauaucggguaauauu

SEQ ID NO: 27991 - RNA, 21 nt, Artificial Sequence
  Marburg virus siRNA sense strand
caaauauaucggguaauauua

SEQ ID NO: 27992 - RNA, 21 nt, Artificial Sequence
  Marburg virus siRNA sense strand
aaauauaucggguaauauuaa

SEQ ID NO: 27993 - RNA, 21 nt, Artificial Sequence
  Marburg virus siRNA sense strand
aauauaucggguaauauuaag

SEQ ID NO: 27994 - RNA, 21 nt, Artificial Sequence
  Marburg virus siRNA sense strand
auauaucggguaauauuaagu

SEQ ID NO: 27995 - RNA, 21 nt, Artificial Sequence
  Marburg virus siRNA sense strand
uauaucggguaauauuaagug

SEQ ID NO: 27996 - RNA, 21 nt, Artificial Sequence
  Marburg virus siRNA sense strand
auaucggguaauauuaagugu

SEQ ID NO: 27997 - RNA, 21 nt, Artificial Sequence
  Marburg virus siRNA sense strand
uaucggguaauauuaagugug

SEQ ID NO: 27998 - RNA, 21 nt, Artificial Sequence
  Marburg virus siRNA sense strand
aucggguaauauuaagugugu

SEQ ID NO: 27999 - RNA, 21 nt, Artificial Sequence
  Marburg virus siRNA sense strand
ucggguaauauuaagugugua

SEQ ID NO: 28000 - RNA, 21 nt, Artificial Sequence
  Marburg virus siRNA sense strand
cggguaauauuaaguguguau

SEQ ID NO: 28001 - RNA, 21 nt, Artificial Sequence
  Marburg virus siRNA sense strand
ggguaauauuaaguguguauu

SEQ ID NO: 28002 - RNA, 21 nt, Artificial Sequence
  Marburg virus siRNA sense strand
gguaauauuaaguguguauug

SEQ ID NO: 28003 - RNA, 21 nt, Artificial Sequence
  Marburg virus siRNA sense strand
guaauauuaaguguguauuga

SEQ ID NO: 28004 - RNA, 21 nt, Artificial Sequence
  Marburg virus siRNA sense strand
uaauauuaaguguguauugau

SEQ ID NO: 28005 - RNA, 21 nt, Artificial Sequence
  Marburg virus siRNA sense strand
aauauuaaguguguauugauu

SEQ ID NO: 28006 - RNA, 21 nt, Artificial Sequence
  Marburg virus siRNA sense strand
auauuaaguguguauugauua

SEQ ID NO: 28007 - RNA, 21 nt, Artificial Sequence
  Marburg virus siRNA sense strand
uauuaaguguguauugauuaa

SEQ ID NO: 28008 - RNA, 21 nt, Artificial Sequence
  Marburg virus siRNA sense strand
auuaaguguguauugauuaaa

SEQ ID NO: 28009 - RNA, 21 nt, Artificial Sequence
  Marburg virus siRNA sense strand
uuaaguguguauugauuaaag

SEQ ID NO: 28010 - RNA, 21 nt, Artificial Sequence
  Marburg virus siRNA sense strand
uaaguguguauugauuaaagc

SEQ ID NO: 28011 - RNA, 21 nt, Artificial Sequence
  Marburg virus siRNA sense strand
aaguguguauugauuaaagcu

SEQ ID NO: 28012 - RNA, 21 nt, Artificial Sequence
  Marburg virus siRNA sense strand
aguguguauugauuaaagcuu

SEQ ID NO: 28013 - RNA, 21 nt, Artificial Sequence
  Marburg virus siRNA sense strand
guguguauugauuaaagcuuu

SEQ ID NO: 28014 - RNA, 21 nt, Artificial Sequence
  Marburg virus siRNA sense strand
uguguauugauuaaagcuuua

SEQ ID NO: 28015 - RNA, 21 nt, Artificial Sequence
  Marburg virus siRNA sense strand
guguauugauuaaagcuuuag

SEQ ID NO: 28016 - RNA, 21 nt, Artificial Sequence
  Marburg virus siRNA sense strand
uguauugauuaaagcuuuagg

SEQ ID NO: 28017 - RNA, 21 nt, Artificial Sequence
  Marburg virus siRNA sense strand
guauugauuaaagcuuuagga

SEQ ID NO: 28018 - RNA, 21 nt, Artificial Sequence
  Marburg virus siRNA sense strand
uauugauuaaagcuuuaggac

SEQ ID NO: 28019 - RNA, 21 nt, Artificial Sequence
  Marburg virus siRNA sense strand
auugauuaaagcuuuaggaca

SEQ ID NO: 28020 - RNA, 21 nt, Artificial Sequence
  Marburg virus siRNA sense strand
uugauuaaagcuuuaggacaa

SEQ ID NO: 28021 - RNA, 21 nt, Artificial Sequence
  Marburg virus siRNA sense strand
ugauuaaagcuuuaggacaau

SEQ ID NO: 28022 - RNA, 21 nt, Artificial Sequence
  Marburg virus siRNA sense strand
gauuaaagcuuuaggacaauu

SEQ ID NO: 28023 - RNA, 21 nt, Artificial Sequence
  Marburg virus siRNA sense strand
auuaaagcuuuaggacaauug

SEQ ID NO: 28024 - RNA, 21 nt, Artificial Sequence
  Marburg virus siRNA sense strand
uuaaagcuuuaggacaauugc

SEQ ID NO: 28025 - RNA, 21 nt, Artificial Sequence
  Marburg virus siRNA sense strand
uaaagcuuuaggacaauugcu

SEQ ID NO: 28026 - RNA, 21 nt, Artificial Sequence
  Marburg virus siRNA sense strand
aaagcuuuaggacaauugcua

SEQ ID NO: 28027 - RNA, 21 nt, Artificial Sequence
  Marburg virus siRNA sense strand
aagcuuuaggacaauugcuac

SEQ ID NO: 28028 - RNA, 21 nt, Artificial Sequence
  Marburg virus siRNA sense strand
agcuuuaggacaauugcuacu

SEQ ID NO: 28029 - RNA, 21 nt, Artificial Sequence
  Marburg virus siRNA sense strand
gcuuuaggacaauugcuacug

SEQ ID NO: 28030 - RNA, 21 nt, Artificial Sequence
  Marburg virus siRNA sense strand
cuuuaggacaauugcuacuga

SEQ ID NO: 28031 - RNA, 21 nt, Artificial Sequence
  Marburg virus siRNA sense strand
uuuaggacaauugcuacugag

SEQ ID NO: 28032 - RNA, 21 nt, Artificial Sequence
  Marburg virus siRNA sense strand
uuaggacaauugcuacugagc

SEQ ID NO: 28033 - RNA, 21 nt, Artificial Sequence
  Marburg virus siRNA sense strand
uaggacaauugcuacugagcc

SEQ ID NO: 28034 - RNA, 21 nt, Artificial Sequence
  Marburg virus siRNA sense strand
aggacaauugcuacugagccc

SEQ ID NO: 28035 - RNA, 21 nt, Artificial Sequence
  Marburg virus siRNA sense strand
ggacaauugcuacugagcccu

SEQ ID NO: 28036 - RNA, 21 nt, Artificial Sequence
  Marburg virus siRNA sense strand
gacaauugcuacugagcccuu

SEQ ID NO: 28037 - RNA, 21 nt, Artificial Sequence
  Marburg virus siRNA sense strand
acaauugcuacugagcccuuc

SEQ ID NO: 28038 - RNA, 21 nt, Artificial Sequence
  Marburg virus siRNA sense strand
caauugcuacugagcccuucu

SEQ ID NO: 28039 - RNA, 21 nt, Artificial Sequence
  Marburg virus siRNA sense strand
aauugcuacugagcccuucuu

SEQ ID NO: 28040 - RNA, 21 nt, Artificial Sequence
  Marburg virus siRNA sense strand
auugcuacugagcccuucuuc

SEQ ID NO: 28041 - RNA, 21 nt, Artificial Sequence
  Marburg virus siRNA sense strand
uugcuacugagcccuucuucu

SEQ ID NO: 28042 - RNA, 21 nt, Artificial Sequence
  Marburg virus siRNA sense strand
ugcuacugagcccuucuucua

SEQ ID NO: 28043 - RNA, 21 nt, Artificial Sequence
  Marburg virus siRNA sense strand
gcuacugagcccuucuucuaa

SEQ ID NO: 28044 - RNA, 21 nt, Artificial Sequence
  Marburg virus siRNA sense strand
cuacugagcccuucuucuaau

SEQ ID NO: 28045 - RNA, 21 nt, Artificial Sequence
  Marburg virus siRNA sense strand
uacugagcccuucuucuaauc

SEQ ID NO: 28046 - RNA, 21 nt, Artificial Sequence
  Marburg virus siRNA sense strand
acugagcccuucuucuaaucu

SEQ ID NO: 28047 - RNA, 21 nt, Artificial Sequence
  Marburg virus siRNA sense strand
cugagcccuucuucuaaucua

SEQ ID NO: 28048 - RNA, 21 nt, Artificial Sequence
  Marburg virus siRNA sense strand
ugagcccuucuucuaaucuac

SEQ ID NO: 28049 - RNA, 21 nt, Artificial Sequence
  Marburg virus siRNA sense strand
gagcccuucuucuaaucuacu

SEQ ID NO: 28050 - RNA, 21 nt, Artificial Sequence
  Marburg virus siRNA sense strand
agcccuucuucuaaucuacug

SEQ ID NO: 28051 - RNA, 21 nt, Artificial Sequence
  Marburg virus siRNA sense strand
gcccuucuucuaaucuacuga

SEQ ID NO: 28052 - RNA, 21 nt, Artificial Sequence
  Marburg virus siRNA sense strand
cccuucuucuaaucuacugaa

SEQ ID NO: 28053 - RNA, 21 nt, Artificial Sequence
  Marburg virus siRNA sense strand
ccuucuucuaaucuacugaaa

SEQ ID NO: 28054 - RNA, 21 nt, Artificial Sequence
  Marburg virus siRNA sense strand
cuucuucuaaucuacugaaau

SEQ ID NO: 28055 - RNA, 21 nt, Artificial Sequence
  Marburg virus siRNA sense strand
uucuucuaaucuacugaaauc

SEQ ID NO: 28056 - RNA, 21 nt, Artificial Sequence
  Marburg virus siRNA sense strand
ucuucuaaucuacugaaauca

SEQ ID NO: 28057 - RNA, 21 nt, Artificial Sequence
  Marburg virus siRNA sense strand
cuucuaaucuacugaaaucaa

SEQ ID NO: 28058 - RNA, 21 nt, Artificial Sequence
  Marburg virus siRNA sense strand
uucuaaucuacugaaaucaac

SEQ ID NO: 28059 - RNA, 21 nt, Artificial Sequence
  Marburg virus siRNA sense strand
ucuaaucuacugaaaucaacu

SEQ ID NO: 28060 - RNA, 21 nt, Artificial Sequence
  Marburg virus siRNA sense strand
cuaaucuacugaaaucaacuu

SEQ ID NO: 28061 - RNA, 21 nt, Artificial Sequence
  Marburg virus siRNA sense strand
uaaucuacugaaaucaacuug

SEQ ID NO: 28062 - RNA, 21 nt, Artificial Sequence
  Marburg virus siRNA sense strand
aaucuacugaaaucaacuugg

SEQ ID NO: 28063 - RNA, 21 nt, Artificial Sequence
  Marburg virus siRNA sense strand
aucuacugaaaucaacuuggg

SEQ ID NO: 28064 - RNA, 21 nt, Artificial Sequence
  Marburg virus siRNA sense strand
ucuacugaaaucaacuuggga

SEQ ID NO: 28065 - RNA, 21 nt, Artificial Sequence
  Marburg virus siRNA sense strand
cuacugaaaucaacuugggag

SEQ ID NO: 28066 - RNA, 21 nt, Artificial Sequence
  Marburg virus siRNA sense strand
uacugaaaucaacuugggaga

SEQ ID NO: 28067 - RNA, 21 nt, Artificial Sequence
  Marburg virus siRNA sense strand
acugaaaucaacuugggagau

SEQ ID NO: 28068 - RNA, 21 nt, Artificial Sequence
  Marburg virus siRNA sense strand
cugaaaucaacuugggagauu

SEQ ID NO: 28069 - RNA, 21 nt, Artificial Sequence
  Marburg virus siRNA sense strand
ugaaaucaacuugggagauuu

SEQ ID NO: 28070 - RNA, 21 nt, Artificial Sequence
  Marburg virus siRNA sense strand
gaaaucaacuugggagauuuu

SEQ ID NO: 28071 - RNA, 21 nt, Artificial Sequence
  Marburg virus siRNA sense strand
aaaucaacuugggagauuuuu

SEQ ID NO: 28072 - RNA, 21 nt, Artificial Sequence
  Marburg virus siRNA sense strand
aaucaacuugggagauuuuua

SEQ ID NO: 28073 - RNA, 21 nt, Artificial Sequence
  Marburg virus siRNA sense strand
aucaacuugggagauuuuuaa

SEQ ID NO: 28074 - RNA, 21 nt, Artificial Sequence
  Marburg virus siRNA sense strand
ucaacuugggagauuuuuaag

SEQ ID NO: 28075 - RNA, 21 nt, Artificial Sequence
  Marburg virus siRNA sense strand
caacuugggagauuuuuaaga

SEQ ID NO: 28076 - RNA, 21 nt, Artificial Sequence
  Marburg virus siRNA sense strand
aacuugggagauuuuuaagaa

SEQ ID NO: 28077 - RNA, 21 nt, Artificial Sequence
  Marburg virus siRNA sense strand
acuugggagauuuuuaagaag

SEQ ID NO: 28078 - RNA, 21 nt, Artificial Sequence
  Marburg virus siRNA sense strand
cuugggagauuuuuaagaagc

SEQ ID NO: 28079 - RNA, 21 nt, Artificial Sequence
  Marburg virus siRNA sense strand
uugggagauuuuuaagaagcu

SEQ ID NO: 28080 - RNA, 21 nt, Artificial Sequence
  Marburg virus siRNA sense strand
ugggagauuuuuaagaagcug

SEQ ID NO: 28081 - RNA, 21 nt, Artificial Sequence
  Marburg virus siRNA sense strand
gggagauuuuuaagaagcuga

SEQ ID NO: 28082 - RNA, 21 nt, Artificial Sequence
  Marburg virus siRNA sense strand
ggagauuuuuaagaagcugau

SEQ ID NO: 28083 - RNA, 21 nt, Artificial Sequence
  Marburg virus siRNA sense strand
gagauuuuuaagaagcugaua

SEQ ID NO: 28084 - RNA, 21 nt, Artificial Sequence
  Marburg virus siRNA sense strand
agauuuuuaagaagcugauaa

SEQ ID NO: 28085 - RNA, 21 nt, Artificial Sequence
  Marburg virus siRNA sense strand
gauuuuuaagaagcugauaau

SEQ ID NO: 28086 - RNA, 21 nt, Artificial Sequence
  Marburg virus siRNA sense strand
auuuuuaagaagcugauaauu

SEQ ID NO: 28087 - RNA, 21 nt, Artificial Sequence
  Marburg virus siRNA sense strand
uuuuuaagaagcugauaauuu

SEQ ID NO: 28088 - RNA, 21 nt, Artificial Sequence
  Marburg virus siRNA sense strand
uuuuaagaagcugauaauuua

SEQ ID NO: 28089 - RNA, 21 nt, Artificial Sequence
  Marburg virus siRNA sense strand
uuuaagaagcugauaauuuaa

SEQ ID NO: 28090 - RNA, 21 nt, Artificial Sequence
  Marburg virus siRNA sense strand
uuaagaagcugauaauuuaau

SEQ ID NO: 28091 - RNA, 21 nt, Artificial Sequence
  Marburg virus siRNA sense strand
uaagaagcugauaauuuaaug

SEQ ID NO: 28092 - RNA, 21 nt, Artificial Sequence
  Marburg virus siRNA sense strand
aagaagcugauaauuuaaugu

SEQ ID NO: 28093 - RNA, 21 nt, Artificial Sequence
  Marburg virus siRNA sense strand
agaagcugauaauuuaaugug

SEQ ID NO: 28094 - RNA, 21 nt, Artificial Sequence
  Marburg virus siRNA sense strand
gaagcugauaauuuaauguga

SEQ ID NO: 28095 - RNA, 21 nt, Artificial Sequence
  Marburg virus siRNA sense strand
aagcugauaauuuaaugugaa

SEQ ID NO: 28096 - RNA, 21 nt, Artificial Sequence
  Marburg virus siRNA sense strand
agcugauaauuuaaugugaau

SEQ ID NO: 28097 - RNA, 21 nt, Artificial Sequence
  Marburg virus siRNA sense strand
gcugauaauuuaaugugaauc

SEQ ID NO: 28098 - RNA, 21 nt, Artificial Sequence
  Marburg virus siRNA sense strand
cugauaauuuaaugugaauca

SEQ ID NO: 28099 - RNA, 21 nt, Artificial Sequence
  Marburg virus siRNA sense strand
ugauaauuuaaugugaaucag

SEQ ID NO: 28100 - RNA, 21 nt, Artificial Sequence
  Marburg virus siRNA sense strand
gauaauuuaaugugaaucagu

SEQ ID NO: 28101 - RNA, 21 nt, Artificial Sequence
  Marburg virus siRNA sense strand
auaauuuaaugugaaucagua

SEQ ID NO: 28102 - RNA, 21 nt, Artificial Sequence
  Marburg virus siRNA sense strand
uaauuuaaugugaaucaguag

SEQ ID NO: 28103 - RNA, 21 nt, Artificial Sequence
  Marburg virus siRNA sense strand
aauuuaaugugaaucaguagu

SEQ ID NO: 28104 - RNA, 21 nt, Artificial Sequence
  Marburg virus siRNA sense strand
auuuaaugugaaucaguaguu

SEQ ID NO: 28105 - RNA, 21 nt, Artificial Sequence
  Marburg virus siRNA sense strand
uuuaaugugaaucaguaguuu

SEQ ID NO: 28106 - RNA, 21 nt, Artificial Sequence
  Marburg virus siRNA sense strand
uuaaugugaaucaguaguuua

SEQ ID NO: 28107 - RNA, 21 nt, Artificial Sequence
  Marburg virus siRNA sense strand
uaaugugaaucaguaguuuac

SEQ ID NO: 28108 - RNA, 21 nt, Artificial Sequence
  Marburg virus siRNA sense strand
aaugugaaucaguaguuuacg

SEQ ID NO: 28109 - RNA, 21 nt, Artificial Sequence
  Marburg virus siRNA sense strand
augugaaucaguaguuuacgu

SEQ ID NO: 28110 - RNA, 21 nt, Artificial Sequence
  Marburg virus siRNA sense strand
ugugaaucaguaguuuacgua

SEQ ID NO: 28111 - RNA, 21 nt, Artificial Sequence
  Marburg virus siRNA sense strand
gugaaucaguaguuuacguau

SEQ ID NO: 28112 - RNA, 21 nt, Artificial Sequence
  Marburg virus siRNA sense strand
ugaaucaguaguuuacguauu

SEQ ID NO: 28113 - RNA, 21 nt, Artificial Sequence
  Marburg virus siRNA sense strand
gaaucaguaguuuacguauug

SEQ ID NO: 28114 - RNA, 21 nt, Artificial Sequence
  Marburg virus siRNA sense strand
aaucaguaguuuacguauugu

SEQ ID NO: 28115 - RNA, 21 nt, Artificial Sequence
  Marburg virus siRNA sense strand
aucaguaguuuacguauuguu

SEQ ID NO: 28116 - RNA, 21 nt, Artificial Sequence
  Marburg virus siRNA sense strand
ucaguaguuuacguauuguug

SEQ ID NO: 28117 - RNA, 21 nt, Artificial Sequence
  Marburg virus siRNA sense strand
caguaguuuacguauuguuga

SEQ ID NO: 28118 - RNA, 21 nt, Artificial Sequence
  Marburg virus siRNA sense strand
aguaguuuacguauuguugau

SEQ ID NO: 28119 - RNA, 21 nt, Artificial Sequence
  Marburg virus siRNA sense strand
guaguuuacguauuguugauu

SEQ ID NO: 28120 - RNA, 21 nt, Artificial Sequence
  Marburg virus siRNA sense strand
uaguuuacguauuguugauug

SEQ ID NO: 28121 - RNA, 21 nt, Artificial Sequence
  Marburg virus siRNA sense strand
aguuuacguauuguugauugu

SEQ ID NO: 28122 - RNA, 21 nt, Artificial Sequence
  Marburg virus siRNA sense strand
guuuacguauuguugauuguu

SEQ ID NO: 28123 - RNA, 21 nt, Artificial Sequence
  Marburg virus siRNA sense strand
uuuacguauuguugauuguua

SEQ ID NO: 28124 - RNA, 21 nt, Artificial Sequence
  Marburg virus siRNA sense strand
uuacguauuguugauuguuau

SEQ ID NO: 28125 - RNA, 21 nt, Artificial Sequence
  Marburg virus siRNA sense strand
uacguauuguugauuguuaug

SEQ ID NO: 28126 - RNA, 21 nt, Artificial Sequence
  Marburg virus siRNA sense strand
acguauuguugauuguuaugg

SEQ ID NO: 28127 - RNA, 21 nt, Artificial Sequence
  Marburg virus siRNA sense strand
cguauuguugauuguuauggu

SEQ ID NO: 28128 - RNA, 21 nt, Artificial Sequence
  Marburg virus siRNA sense strand
guauuguugauuguuaugguu

SEQ ID NO: 28129 - RNA, 21 nt, Artificial Sequence
  Marburg virus siRNA sense strand
uauuguugauuguuaugguuu

SEQ ID NO: 28130 - RNA, 21 nt, Artificial Sequence
  Marburg virus siRNA sense strand
auuguugauuguuaugguuug

SEQ ID NO: 28131 - RNA, 21 nt, Artificial Sequence
  Marburg virus siRNA sense strand
uuguugauuguuaugguuuga

SEQ ID NO: 28132 - RNA, 21 nt, Artificial Sequence
  Marburg virus siRNA sense strand
uguugauuguuaugguuugau

SEQ ID NO: 28133 - RNA, 21 nt, Artificial Sequence
  Marburg virus siRNA sense strand
guugauuguuaugguuugaua

SEQ ID NO: 28134 - RNA, 21 nt, Artificial Sequence
  Marburg virus siRNA sense strand
uugauuguuaugguuugauau

SEQ ID NO: 28135 - RNA, 21 nt, Artificial Sequence
  Marburg virus siRNA sense strand
ugauuguuaugguuugauauu

SEQ ID NO: 28136 - RNA, 21 nt, Artificial Sequence
  Marburg virus siRNA sense strand
gauuguuaugguuugauauuc

SEQ ID NO: 28137 - RNA, 21 nt, Artificial Sequence
  Marburg virus siRNA sense strand
auuguuaugguuugauauuca

SEQ ID NO: 28138 - RNA, 21 nt, Artificial Sequence
  Marburg virus siRNA sense strand
uuguuaugguuugauauucaa

SEQ ID NO: 28139 - RNA, 21 nt, Artificial Sequence
  Marburg virus siRNA sense strand
uguuaugguuugauauucaau

SEQ ID NO: 28140 - RNA, 21 nt, Artificial Sequence
  Marburg virus siRNA sense strand
guuaugguuugauauucaauu

SEQ ID NO: 28141 - RNA, 21 nt, Artificial Sequence
  Marburg virus siRNA sense strand
uuaugguuugauauucaauug

SEQ ID NO: 28142 - RNA, 21 nt, Artificial Sequence
  Marburg virus siRNA sense strand
uaugguuugauauucaauugu

SEQ ID NO: 28143 - RNA, 21 nt, Artificial Sequence
  Marburg virus siRNA sense strand
augguuugauauucaauuguu

SEQ ID NO: 28144 - RNA, 21 nt, Artificial Sequence
  Marburg virus siRNA sense strand
ugguuugauauucaauuguua

SEQ ID NO: 28145 - RNA, 21 nt, Artificial Sequence
  Marburg virus siRNA sense strand
gguuugauauucaauuguuau

SEQ ID NO: 28146 - RNA, 21 nt, Artificial Sequence
  Marburg virus siRNA sense strand
guuugauauucaauuguuauc

SEQ ID NO: 28147 - RNA, 21 nt, Artificial Sequence
  Marburg virus siRNA sense strand
uuugauauucaauuguuauca

SEQ ID NO: 28148 - RNA, 21 nt, Artificial Sequence
  Marburg virus siRNA sense strand
uugauauucaauuguuaucau

SEQ ID NO: 28149 - RNA, 21 nt, Artificial Sequence
  Marburg virus siRNA sense strand
ugauauucaauuguuaucaua

SEQ ID NO: 28150 - RNA, 21 nt, Artificial Sequence
  Marburg virus siRNA sense strand
gauauucaauuguuaucauag

SEQ ID NO: 28151 - RNA, 21 nt, Artificial Sequence
  Marburg virus siRNA sense strand
auauucaauuguuaucauagu

SEQ ID NO: 28152 - RNA, 21 nt, Artificial Sequence
  Marburg virus siRNA sense strand
uauucaauuguuaucauaguc

SEQ ID NO: 28153 - RNA, 21 nt, Artificial Sequence
  Marburg virus siRNA sense strand
auucaauuguuaucauaguca

SEQ ID NO: 28154 - RNA, 21 nt, Artificial Sequence
  Marburg virus siRNA sense strand
uucaauuguuaucauagucaa

SEQ ID NO: 28155 - RNA, 21 nt, Artificial Sequence
  Marburg virus siRNA sense strand
ucaauuguuaucauagucaag

SEQ ID NO: 28156 - RNA, 21 nt, Artificial Sequence
  Marburg virus siRNA sense strand
caauuguuaucauagucaaga

SEQ ID NO: 28157 - RNA, 21 nt, Artificial Sequence
  Marburg virus siRNA sense strand
aauuguuaucauagucaagag

SEQ ID NO: 28158 - RNA, 21 nt, Artificial Sequence
  Marburg virus siRNA sense strand
auuguuaucauagucaagagu

SEQ ID NO: 28159 - RNA, 21 nt, Artificial Sequence
  Marburg virus siRNA sense strand
uuguuaucauagucaagagua

SEQ ID NO: 28160 - RNA, 21 nt, Artificial Sequence
  Marburg virus siRNA sense strand
uguuaucauagucaagaguaa

SEQ ID NO: 28161 - RNA, 21 nt, Artificial Sequence
  Marburg virus siRNA sense strand
guuaucauagucaagaguaac

SEQ ID NO: 28162 - RNA, 21 nt, Artificial Sequence
  Marburg virus siRNA sense strand
uuaucauagucaagaguaacc

SEQ ID NO: 28163 - RNA, 21 nt, Artificial Sequence
  Marburg virus siRNA sense strand
uaucauagucaagaguaaccu

SEQ ID NO: 28164 - RNA, 21 nt, Artificial Sequence
  Marburg virus siRNA sense strand
aucauagucaagaguaaccuu

SEQ ID NO: 28165 - RNA, 21 nt, Artificial Sequence
  Marburg virus siRNA sense strand
ucauagucaagaguaaccuuu

SEQ ID NO: 28166 - RNA, 21 nt, Artificial Sequence
  Marburg virus siRNA sense strand
cauagucaagaguaaccuuuu

SEQ ID NO: 28167 - RNA, 21 nt, Artificial Sequence
  Marburg virus siRNA sense strand
auagucaagaguaaccuuuuc

SEQ ID NO: 28168 - RNA, 21 nt, Artificial Sequence
  Marburg virus siRNA sense strand
uagucaagaguaaccuuuucu

SEQ ID NO: 28169 - RNA, 21 nt, Artificial Sequence
  Marburg virus siRNA sense strand
agucaagaguaaccuuuucua

SEQ ID NO: 28170 - RNA, 21 nt, Artificial Sequence
  Marburg virus siRNA sense strand
gucaagaguaaccuuuucuau

SEQ ID NO: 28171 - RNA, 21 nt, Artificial Sequence
  Marburg virus siRNA sense strand
ucaagaguaaccuuuucuauu

SEQ ID NO: 28172 - RNA, 21 nt, Artificial Sequence
  Marburg virus siRNA sense strand
caagaguaaccuuuucuauuu

SEQ ID NO: 28173 - RNA, 21 nt, Artificial Sequence
  Marburg virus siRNA sense strand
aagaguaaccuuuucuauuug

SEQ ID NO: 28174 - RNA, 21 nt, Artificial Sequence
  Marburg virus siRNA sense strand
agaguaaccuuuucuauuuga

SEQ ID NO: 28175 - RNA, 21 nt, Artificial Sequence
  Marburg virus siRNA sense strand
gaguaaccuuuucuauuugau

SEQ ID NO: 28176 - RNA, 21 nt, Artificial Sequence
  Marburg virus siRNA sense strand
aguaaccuuuucuauuugaug

SEQ ID NO: 28177 - RNA, 21 nt, Artificial Sequence
  Marburg virus siRNA sense strand
guaaccuuuucuauuugaugc

SEQ ID NO: 28178 - RNA, 21 nt, Artificial Sequence
  Marburg virus siRNA sense strand
uaaccuuuucuauuugaugca

SEQ ID NO: 28179 - RNA, 21 nt, Artificial Sequence
  Marburg virus siRNA sense strand
aaccuuuucuauuugaugcau

SEQ ID NO: 28180 - RNA, 21 nt, Artificial Sequence
  Marburg virus siRNA sense strand
accuuuucuauuugaugcauu

SEQ ID NO: 28181 - RNA, 21 nt, Artificial Sequence
  Marburg virus siRNA sense strand
ccuuuucuauuugaugcauua

SEQ ID NO: 28182 - RNA, 21 nt, Artificial Sequence
  Marburg virus siRNA sense strand
cuuuucuauuugaugcauuaa

SEQ ID NO: 28183 - RNA, 21 nt, Artificial Sequence
  Marburg virus siRNA sense strand
uuuucuauuugaugcauuaau

SEQ ID NO: 28184 - RNA, 21 nt, Artificial Sequence
  Marburg virus siRNA sense strand
uuucuauuugaugcauuaaug

SEQ ID NO: 28185 - RNA, 21 nt, Artificial Sequence
  Marburg virus siRNA sense strand
uucuauuugaugcauuaaugu

SEQ ID NO: 28186 - RNA, 21 nt, Artificial Sequence
  Marburg virus siRNA sense strand
ucuauuugaugcauuaauguu

SEQ ID NO: 28187 - RNA, 21 nt, Artificial Sequence
  Marburg virus siRNA sense strand
cuauuugaugcauuaauguuu

SEQ ID NO: 28188 - RNA, 21 nt, Artificial Sequence
  Marburg virus siRNA sense strand
uauuugaugcauuaauguuuu

SEQ ID NO: 28189 - RNA, 21 nt, Artificial Sequence
  Marburg virus siRNA sense strand
auuugaugcauuaauguuuua

SEQ ID NO: 28190 - RNA, 21 nt, Artificial Sequence
  Marburg virus siRNA sense strand
uuugaugcauuaauguuuuaa

SEQ ID NO: 28191 - RNA, 21 nt, Artificial Sequence
  Marburg virus siRNA sense strand
uugaugcauuaauguuuuaaa

SEQ ID NO: 28192 - RNA, 21 nt, Artificial Sequence
  Marburg virus siRNA sense strand
ugaugcauuaauguuuuaaac

SEQ ID NO: 28193 - RNA, 21 nt, Artificial Sequence
  Marburg virus siRNA sense strand
gaugcauuaauguuuuaaacu

SEQ ID NO: 28194 - RNA, 21 nt, Artificial Sequence
  Marburg virus siRNA sense strand
augcauuaauguuuuaaacua

SEQ ID NO: 28195 - RNA, 21 nt, Artificial Sequence
  Marburg virus siRNA sense strand
ugcauuaauguuuuaaacuac

SEQ ID NO: 28196 - RNA, 21 nt, Artificial Sequence
  Marburg virus siRNA sense strand
gcauuaauguuuuaaacuacc

SEQ ID NO: 28197 - RNA, 21 nt, Artificial Sequence
  Marburg virus siRNA sense strand
cauuaauguuuuaaacuaccu

SEQ ID NO: 28198 - RNA, 21 nt, Artificial Sequence
  Marburg virus siRNA sense strand
auuaauguuuuaaacuaccuc

SEQ ID NO: 28199 - RNA, 21 nt, Artificial Sequence
  Marburg virus siRNA sense strand
uuaauguuuuaaacuaccucu

SEQ ID NO: 28200 - RNA, 21 nt, Artificial Sequence
  Marburg virus siRNA sense strand
uaauguuuuaaacuaccucuu

SEQ ID NO: 28201 - RNA, 21 nt, Artificial Sequence
  Marburg virus siRNA sense strand
aauguuuuaaacuaccucuua

SEQ ID NO: 28202 - RNA, 21 nt, Artificial Sequence
  Marburg virus siRNA sense strand
auguuuuaaacuaccucuuaa

SEQ ID NO: 28203 - RNA, 21 nt, Artificial Sequence
  Marburg virus siRNA sense strand
uguuuuaaacuaccucuuaag

SEQ ID NO: 28204 - RNA, 21 nt, Artificial Sequence
  Marburg virus siRNA sense strand
guuuuaaacuaccucuuaagc

SEQ ID NO: 28205 - RNA, 21 nt, Artificial Sequence
  Marburg virus siRNA sense strand
uuuuaaacuaccucuuaagcu

SEQ ID NO: 28206 - RNA, 21 nt, Artificial Sequence
  Marburg virus siRNA sense strand
uuuaaacuaccucuuaagcuu

SEQ ID NO: 28207 - RNA, 21 nt, Artificial Sequence
  Marburg virus siRNA sense strand
uuaaacuaccucuuaagcuuu

SEQ ID NO: 28208 - RNA, 21 nt, Artificial Sequence
  Marburg virus siRNA sense strand
uaaacuaccucuuaagcuuuu

SEQ ID NO: 28209 - RNA, 21 nt, Artificial Sequence
  Marburg virus siRNA sense strand
aaacuaccucuuaagcuuuug

SEQ ID NO: 28210 - RNA, 21 nt, Artificial Sequence
  Marburg virus siRNA sense strand
aacuaccucuuaagcuuuugu

SEQ ID NO: 28211 - RNA, 21 nt, Artificial Sequence
  Marburg virus siRNA sense strand
acuaccucuuaagcuuuugug

SEQ ID NO: 28212 - RNA, 21 nt, Artificial Sequence
  Marburg virus siRNA sense strand
cuaccucuuaagcuuuugugg

SEQ ID NO: 28213 - RNA, 21 nt, Artificial Sequence
  Marburg virus siRNA sense strand
uaccucuuaagcuuuugugga

SEQ ID NO: 28214 - RNA, 21 nt, Artificial Sequence
  Marburg virus siRNA sense strand
accucuuaagcuuuuguggau

SEQ ID NO: 28215 - RNA, 21 nt, Artificial Sequence
  Marburg virus siRNA sense strand
ccucuuaagcuuuuguggaug

SEQ ID NO: 28216 - RNA, 21 nt, Artificial Sequence
  Marburg virus siRNA sense strand
cucuuaagcuuuuguggaugg

SEQ ID NO: 28217 - RNA, 21 nt, Artificial Sequence
  Marburg virus siRNA sense strand
ucuuaagcuuuuguggauggu

SEQ ID NO: 28218 - RNA, 21 nt, Artificial Sequence
  Marburg virus siRNA sense strand
cuuaagcuuuuguggaugguu

SEQ ID NO: 28219 - RNA, 21 nt, Artificial Sequence
  Marburg virus siRNA sense strand
uuaagcuuuuguggaugguuu

SEQ ID NO: 28220 - RNA, 21 nt, Artificial Sequence
  Marburg virus siRNA sense strand
uaagcuuuuguggaugguuuc

SEQ ID NO: 28221 - RNA, 21 nt, Artificial Sequence
  Marburg virus siRNA sense strand
aagcuuuuguggaugguuuca

SEQ ID NO: 28222 - RNA, 21 nt, Artificial Sequence
  Marburg virus siRNA sense strand
agcuuuuguggaugguuucaa

SEQ ID NO: 28223 - RNA, 21 nt, Artificial Sequence
  Marburg virus siRNA sense strand
gcuuuuguggaugguuucaau

SEQ ID NO: 28224 - RNA, 21 nt, Artificial Sequence
  Marburg virus siRNA sense strand
cuuuuguggaugguuucaaua

SEQ ID NO: 28225 - RNA, 21 nt, Artificial Sequence
  Marburg virus siRNA sense strand
uuuuguggaugguuucaauau

SEQ ID NO: 28226 - RNA, 21 nt, Artificial Sequence
  Marburg virus siRNA sense strand
uuuguggaugguuucaauaug

SEQ ID NO: 28227 - RNA, 21 nt, Artificial Sequence
  Marburg virus siRNA sense strand
uuguggaugguuucaauaugu

SEQ ID NO: 28228 - RNA, 21 nt, Artificial Sequence
  Marburg virus siRNA sense strand
uguggaugguuucaauaugug

SEQ ID NO: 28229 - RNA, 21 nt, Artificial Sequence
  Marburg virus siRNA sense strand
guggaugguuucaauaugugc

SEQ ID NO: 28230 - RNA, 21 nt, Artificial Sequence
  Marburg virus siRNA sense strand
uggaugguuucaauaugugcg

SEQ ID NO: 28231 - RNA, 21 nt, Artificial Sequence
  Marburg virus siRNA sense strand
ggaugguuucaauaugugcgu

SEQ ID NO: 28232 - RNA, 21 nt, Artificial Sequence
  Marburg virus siRNA sense strand
gaugguuucaauaugugcgua

SEQ ID NO: 28233 - RNA, 21 nt, Artificial Sequence
  Marburg virus siRNA sense strand
augguuucaauaugugcguag

SEQ ID NO: 28234 - RNA, 21 nt, Artificial Sequence
  Marburg virus siRNA sense strand
ugguuucaauaugugcguaga

SEQ ID NO: 28235 - RNA, 21 nt, Artificial Sequence
  Marburg virus siRNA sense strand
gguuucaauaugugcguagag

SEQ ID NO: 28236 - RNA, 21 nt, Artificial Sequence
  Marburg virus siRNA sense strand
guuucaauaugugcguagagg

SEQ ID NO: 28237 - RNA, 21 nt, Artificial Sequence
  Marburg virus siRNA sense strand
uuucaauaugugcguagaggu

SEQ ID NO: 28238 - RNA, 21 nt, Artificial Sequence
  Marburg virus siRNA sense strand
uucaauaugugcguagagguu

SEQ ID NO: 28239 - RNA, 21 nt, Artificial Sequence
  Marburg virus siRNA sense strand
ucaauaugugcguagagguua

SEQ ID NO: 28240 - RNA, 21 nt, Artificial Sequence
  Marburg virus siRNA sense strand
caauaugugcguagagguuaa

SEQ ID NO: 28241 - RNA, 21 nt, Artificial Sequence
  Marburg virus siRNA sense strand
aauaugugcguagagguuaau

SEQ ID NO: 28242 - RNA, 21 nt, Artificial Sequence
  Marburg virus siRNA sense strand
auaugugcguagagguuaauu

SEQ ID NO: 28243 - RNA, 21 nt, Artificial Sequence
  Marburg virus siRNA sense strand
uaugugcguagagguuaauuu

SEQ ID NO: 28244 - RNA, 21 nt, Artificial Sequence
  Marburg virus siRNA sense strand
augugcguagagguuaauuua

SEQ ID NO: 28245 - RNA, 21 nt, Artificial Sequence
  Marburg virus siRNA sense strand
ugugcguagagguuaauuuaa

SEQ ID NO: 28246 - RNA, 21 nt, Artificial Sequence
  Marburg virus siRNA sense strand
gugcguagagguuaauuuaaa

SEQ ID NO: 28247 - RNA, 21 nt, Artificial Sequence
  Marburg virus siRNA sense strand
ugcguagagguuaauuuaaag

SEQ ID NO: 28248 - RNA, 21 nt, Artificial Sequence
  Marburg virus siRNA sense strand
gcguagagguuaauuuaaaga

SEQ ID NO: 28249 - RNA, 21 nt, Artificial Sequence
  Marburg virus siRNA sense strand
cguagagguuaauuuaaagag

SEQ ID NO: 28250 - RNA, 21 nt, Artificial Sequence
  Marburg virus siRNA sense strand
guagagguuaauuuaaagaga

SEQ ID NO: 28251 - RNA, 21 nt, Artificial Sequence
  Marburg virus siRNA sense strand
uagagguuaauuuaaagagau

SEQ ID NO: 28252 - RNA, 21 nt, Artificial Sequence
  Marburg virus siRNA sense strand
agagguuaauuuaaagagauu

SEQ ID NO: 28253 - RNA, 21 nt, Artificial Sequence
  Marburg virus siRNA sense strand
gagguuaauuuaaagagauuu

SEQ ID NO: 28254 - RNA, 21 nt, Artificial Sequence
  Marburg virus siRNA sense strand
agguuaauuuaaagagauuuc

SEQ ID NO: 28255 - RNA, 21 nt, Artificial Sequence
  Marburg virus siRNA sense strand
gguuaauuuaaagagauuucu

SEQ ID NO: 28256 - RNA, 21 nt, Artificial Sequence
  Marburg virus siRNA sense strand
guuaauuuaaagagauuucuu

SEQ ID NO: 28257 - RNA, 21 nt, Artificial Sequence
  Marburg virus siRNA sense strand
uuaauuuaaagagauuucuug

SEQ ID NO: 28258 - RNA, 21 nt, Artificial Sequence
  Marburg virus siRNA sense strand
uaauuuaaagagauuucuugu

SEQ ID NO: 28259 - RNA, 21 nt, Artificial Sequence
  Marburg virus siRNA sense strand
aauuuaaagagauuucuuguu

SEQ ID NO: 28260 - RNA, 21 nt, Artificial Sequence
  Marburg virus siRNA sense strand
auuuaaagagauuucuuguug

SEQ ID NO: 28261 - RNA, 21 nt, Artificial Sequence
  Marburg virus siRNA sense strand
uuuaaagagauuucuuguugc

SEQ ID NO: 28262 - RNA, 21 nt, Artificial Sequence
  Marburg virus siRNA sense strand
uuaaagagauuucuuguugca

SEQ ID NO: 28263 - RNA, 21 nt, Artificial Sequence
  Marburg virus siRNA sense strand
uaaagagauuucuuguugcac

SEQ ID NO: 28264 - RNA, 21 nt, Artificial Sequence
  Marburg virus siRNA sense strand
aaagagauuucuuguugcaca

SEQ ID NO: 28265 - RNA, 21 nt, Artificial Sequence
  Marburg virus siRNA sense strand
aagagauuucuuguugcacag

SEQ ID NO: 28266 - RNA, 21 nt, Artificial Sequence
  Marburg virus siRNA sense strand
agagauuucuuguugcacagu

SEQ ID NO: 28267 - RNA, 21 nt, Artificial Sequence
  Marburg virus siRNA sense strand
gagauuucuuguugcacaguu

SEQ ID NO: 28268 - RNA, 21 nt, Artificial Sequence
  Marburg virus siRNA sense strand
agauuucuuguugcacaguuu

SEQ ID NO: 28269 - RNA, 21 nt, Artificial Sequence
  Marburg virus siRNA sense strand
gauuucuuguugcacaguuuu

SEQ ID NO: 28270 - RNA, 21 nt, Artificial Sequence
  Marburg virus siRNA sense strand
auuucuuguugcacaguuuuu

SEQ ID NO: 28271 - RNA, 21 nt, Artificial Sequence
  Marburg virus siRNA sense strand
uuucuuguugcacaguuuuuu

SEQ ID NO: 28272 - RNA, 21 nt, Artificial Sequence
  Marburg virus siRNA sense strand
uucuuguugcacaguuuuuug

SEQ ID NO: 28273 - RNA, 21 nt, Artificial Sequence
  Marburg virus siRNA sense strand
ucuuguugcacaguuuuuugu

SEQ ID NO: 28274 - RNA, 21 nt, Artificial Sequence
  Marburg virus siRNA sense strand
cuuguugcacaguuuuuugua

SEQ ID NO: 28275 - RNA, 21 nt, Artificial Sequence
  Marburg virus siRNA sense strand
uuguugcacaguuuuuuguau

SEQ ID NO: 28276 - RNA, 21 nt, Artificial Sequence
  Marburg virus siRNA sense strand
uguugcacaguuuuuuguauu

SEQ ID NO: 28277 - RNA, 21 nt, Artificial Sequence
  Marburg virus siRNA sense strand
guugcacaguuuuuuguauua

SEQ ID NO: 28278 - RNA, 21 nt, Artificial Sequence
  Marburg virus siRNA sense strand
uugcacaguuuuuuguauuac

SEQ ID NO: 28279 - RNA, 21 nt, Artificial Sequence
  Marburg virus siRNA sense strand
ugcacaguuuuuuguauuacu

SEQ ID NO: 28280 - RNA, 21 nt, Artificial Sequence
  Marburg virus siRNA sense strand
gcacaguuuuuuguauuacuu

SEQ ID NO: 28281 - RNA, 21 nt, Artificial Sequence
  Marburg virus siRNA sense strand
cacaguuuuuuguauuacuua

SEQ ID NO: 28282 - RNA, 21 nt, Artificial Sequence
  Marburg virus siRNA sense strand
acaguuuuuuguauuacuuac

SEQ ID NO: 28283 - RNA, 21 nt, Artificial Sequence
  Marburg virus siRNA sense strand
caguuuuuuguauuacuuacu

SEQ ID NO: 28284 - RNA, 21 nt, Artificial Sequence
  Marburg virus siRNA sense strand
aguuuuuuguauuacuuacuu

SEQ ID NO: 28285 - RNA, 21 nt, Artificial Sequence
  Marburg virus siRNA sense strand
guuuuuuguauuacuuacuug

SEQ ID NO: 28286 - RNA, 21 nt, Artificial Sequence
  Marburg virus siRNA sense strand
uuuuuuguauuacuuacuugg

SEQ ID NO: 28287 - RNA, 21 nt, Artificial Sequence
  Marburg virus siRNA sense strand
uuuuuguauuacuuacuuggg

SEQ ID NO: 28288 - RNA, 21 nt, Artificial Sequence
  Marburg virus siRNA sense strand
uuuuguauuacuuacuugggc

SEQ ID NO: 28289 - RNA, 21 nt, Artificial Sequence
  Marburg virus siRNA sense strand
uuuguauuacuuacuugggcu

SEQ ID NO: 28290 - RNA, 21 nt, Artificial Sequence
  Marburg virus siRNA sense strand
uuguauuacuuacuugggcuu

SEQ ID NO: 28291 - RNA, 21 nt, Artificial Sequence
  Marburg virus siRNA sense strand
uguauuacuuacuugggcuug

SEQ ID NO: 28292 - RNA, 21 nt, Artificial Sequence
  Marburg virus siRNA sense strand
guauuacuuacuugggcuuga

SEQ ID NO: 28293 - RNA, 21 nt, Artificial Sequence
  Marburg virus siRNA sense strand
uauuacuuacuugggcuugaa

SEQ ID NO: 28294 - RNA, 21 nt, Artificial Sequence
  Marburg virus siRNA sense strand
auuacuuacuugggcuugaag

SEQ ID NO: 28295 - RNA, 21 nt, Artificial Sequence
  Marburg virus siRNA sense strand
uuacuuacuugggcuugaaga

SEQ ID NO: 28296 - RNA, 21 nt, Artificial Sequence
  Marburg virus siRNA sense strand
uacuuacuugggcuugaagac

SEQ ID NO: 28297 - RNA, 21 nt, Artificial Sequence
  Marburg virus siRNA sense strand
acuuacuugggcuugaagaca

SEQ ID NO: 28298 - RNA, 21 nt, Artificial Sequence
  Marburg virus siRNA sense strand
cuuacuugggcuugaagacau

SEQ ID NO: 28299 - RNA, 21 nt, Artificial Sequence
  Marburg virus siRNA sense strand
uuacuugggcuugaagacaua

SEQ ID NO: 28300 - RNA, 21 nt, Artificial Sequence
  Marburg virus siRNA sense strand
uacuugggcuugaagacauag

SEQ ID NO: 28301 - RNA, 21 nt, Artificial Sequence
  Marburg virus siRNA sense strand
acuugggcuugaagacauagu

SEQ ID NO: 28302 - RNA, 21 nt, Artificial Sequence
  Marburg virus siRNA sense strand
cuugggcuugaagacauaguu

SEQ ID NO: 28303 - RNA, 21 nt, Artificial Sequence
  Marburg virus siRNA sense strand
uugggcuugaagacauaguua

SEQ ID NO: 28304 - RNA, 21 nt, Artificial Sequence
  Marburg virus siRNA sense strand
ugggcuugaagacauaguuaa

SEQ ID NO: 28305 - RNA, 21 nt, Artificial Sequence
  Marburg virus siRNA sense strand
gggcuugaagacauaguuaag

SEQ ID NO: 28306 - RNA, 21 nt, Artificial Sequence
  Marburg virus siRNA sense strand
ggcuugaagacauaguuaaga

SEQ ID NO: 28307 - RNA, 21 nt, Artificial Sequence
  Marburg virus siRNA sense strand
gcuugaagacauaguuaagac

SEQ ID NO: 28308 - RNA, 21 nt, Artificial Sequence
  Marburg virus siRNA sense strand
cuugaagacauaguuaagacu

SEQ ID NO: 28309 - RNA, 21 nt, Artificial Sequence
  Marburg virus siRNA sense strand
uugaagacauaguuaagacug

SEQ ID NO: 28310 - RNA, 21 nt, Artificial Sequence
  Marburg virus siRNA sense strand
ugaagacauaguuaagacugg

SEQ ID NO: 28311 - RNA, 21 nt, Artificial Sequence
  Marburg virus siRNA sense strand
gaagacauaguuaagacuggc

SEQ ID NO: 28312 - RNA, 21 nt, Artificial Sequence
  Marburg virus siRNA sense strand
aagacauaguuaagacuggcc

SEQ ID NO: 28313 - RNA, 21 nt, Artificial Sequence
  Marburg virus siRNA sense strand
agacauaguuaagacuggccg

SEQ ID NO: 28314 - RNA, 21 nt, Artificial Sequence
  Marburg virus siRNA sense strand
gacauaguuaagacuggccga

SEQ ID NO: 28315 - RNA, 21 nt, Artificial Sequence
  Marburg virus siRNA sense strand
acauaguuaagacuggccgaa

SEQ ID NO: 28316 - RNA, 21 nt, Artificial Sequence
  Marburg virus siRNA sense strand
cauaguuaagacuggccgaaa

SEQ ID NO: 28317 - RNA, 21 nt, Artificial Sequence
  Marburg virus siRNA sense strand
auaguuaagacuggccgaaaa

SEQ ID NO: 28318 - RNA, 21 nt, Artificial Sequence
  Marburg virus siRNA sense strand
uaguuaagacuggccgaaaau

SEQ ID NO: 28319 - RNA, 21 nt, Artificial Sequence
  Marburg virus siRNA sense strand
aguuaagacuggccgaaaaug

SEQ ID NO: 28320 - RNA, 21 nt, Artificial Sequence
  Marburg virus siRNA sense strand
guuaagacuggccgaaaaugc

SEQ ID NO: 28321 - RNA, 21 nt, Artificial Sequence
  Marburg virus siRNA sense strand
uuaagacuggccgaaaaugcu

SEQ ID NO: 28322 - RNA, 21 nt, Artificial Sequence
  Marburg virus siRNA sense strand
uaagacuggccgaaaaugcuc

SEQ ID NO: 28323 - RNA, 21 nt, Artificial Sequence
  Marburg virus siRNA sense strand
aagacuggccgaaaaugcucu

SEQ ID NO: 28324 - RNA, 21 nt, Artificial Sequence
  Marburg virus siRNA sense strand
agacuggccgaaaaugcucuc

SEQ ID NO: 28325 - RNA, 21 nt, Artificial Sequence
  Marburg virus siRNA sense strand
gacuggccgaaaaugcucucc

SEQ ID NO: 28326 - RNA, 21 nt, Artificial Sequence
  Marburg virus siRNA sense strand
acuggccgaaaaugcucucca

SEQ ID NO: 28327 - RNA, 21 nt, Artificial Sequence
  Marburg virus siRNA sense strand
cuggccgaaaaugcucuccag

SEQ ID NO: 28328 - RNA, 21 nt, Artificial Sequence
  Marburg virus siRNA sense strand
uggccgaaaaugcucuccagu

SEQ ID NO: 28329 - RNA, 21 nt, Artificial Sequence
  Marburg virus siRNA sense strand
ggccgaaaaugcucuccaguc

SEQ ID NO: 28330 - RNA, 21 nt, Artificial Sequence
  Marburg virus siRNA sense strand
gccgaaaaugcucuccaguca

SEQ ID NO: 28331 - RNA, 21 nt, Artificial Sequence
  Marburg virus siRNA sense strand
ccgaaaaugcucuccagucaa

SEQ ID NO: 28332 - RNA, 21 nt, Artificial Sequence
  Marburg virus siRNA sense strand
cgaaaaugcucuccagucaac

SEQ ID NO: 28333 - RNA, 21 nt, Artificial Sequence
  Marburg virus siRNA sense strand
gaaaaugcucuccagucaacu

SEQ ID NO: 28334 - RNA, 21 nt, Artificial Sequence
  Marburg virus siRNA sense strand
aaaaugcucuccagucaacuc

SEQ ID NO: 28335 - RNA, 21 nt, Artificial Sequence
  Marburg virus siRNA sense strand
aaaugcucuccagucaacucc

SEQ ID NO: 28336 - RNA, 21 nt, Artificial Sequence
  Marburg virus siRNA sense strand
aaugcucuccagucaacucca

SEQ ID NO: 28337 - RNA, 21 nt, Artificial Sequence
  Marburg virus siRNA sense strand
augcucuccagucaacuccau

SEQ ID NO: 28338 - RNA, 21 nt, Artificial Sequence
  Marburg virus siRNA sense strand
ugcucuccagucaacuccauu

SEQ ID NO: 28339 - RNA, 21 nt, Artificial Sequence
  Marburg virus siRNA sense strand
gcucuccagucaacuccauuc

SEQ ID NO: 28340 - RNA, 21 nt, Artificial Sequence
  Marburg virus siRNA sense strand
cucuccagucaacuccauucc

SEQ ID NO: 28341 - RNA, 21 nt, Artificial Sequence
  Marburg virus siRNA sense strand
ucuccagucaacuccauuccc

SEQ ID NO: 28342 - RNA, 21 nt, Artificial Sequence
  Marburg virus siRNA sense strand
cuccagucaacuccauucccc

SEQ ID NO: 28343 - RNA, 21 nt, Artificial Sequence
  Marburg virus siRNA sense strand
uccagucaacuccauuccccc

SEQ ID NO: 28344 - RNA, 21 nt, Artificial Sequence
  Marburg virus siRNA sense strand
ccagucaacuccauucccccu

SEQ ID NO: 28345 - RNA, 21 nt, Artificial Sequence
  Marburg virus siRNA sense strand
cagucaacuccauucccccuc

SEQ ID NO: 28346 - RNA, 21 nt, Artificial Sequence
  Marburg virus siRNA sense strand
agucaacuccauucccccuca

SEQ ID NO: 28347 - RNA, 21 nt, Artificial Sequence
  Marburg virus siRNA sense strand
gucaacuccauucccccucag

SEQ ID NO: 28348 - RNA, 21 nt, Artificial Sequence
  Marburg virus siRNA sense strand
ucaacuccauucccccucaga

SEQ ID NO: 28349 - RNA, 21 nt, Artificial Sequence
  Marburg virus siRNA sense strand
caacuccauucccccucagaa

SEQ ID NO: 28350 - RNA, 21 nt, Artificial Sequence
  Marburg virus siRNA sense strand
aacuccauucccccucagaag

SEQ ID NO: 28351 - RNA, 21 nt, Artificial Sequence
  Marburg virus siRNA sense strand
acuccauucccccucagaaga

SEQ ID NO: 28352 - RNA, 21 nt, Artificial Sequence
  Marburg virus siRNA sense strand
cuccauucccccucagaagag

SEQ ID NO: 28353 - RNA, 21 nt, Artificial Sequence
  Marburg virus siRNA sense strand
uccauucccccucagaagaga

SEQ ID NO: 28354 - RNA, 21 nt, Artificial Sequence
  Marburg virus siRNA sense strand
ccauucccccucagaagagac

SEQ ID NO: 28355 - RNA, 21 nt, Artificial Sequence
  Marburg virus siRNA sense strand
cauucccccucagaagagacg

SEQ ID NO: 28356 - RNA, 21 nt, Artificial Sequence
  Marburg virus siRNA sense strand
auucccccucagaagagacgu

SEQ ID NO: 28357 - RNA, 21 nt, Artificial Sequence
  Marburg virus siRNA sense strand
uucccccucagaagagacgug

SEQ ID NO: 28358 - RNA, 21 nt, Artificial Sequence
  Marburg virus siRNA sense strand
ucccccucagaagagacgugc

SEQ ID NO: 28359 - RNA, 21 nt, Artificial Sequence
  Marburg virus siRNA sense strand
cccccucagaagagacgugcc

SEQ ID NO: 28360 - RNA, 21 nt, Artificial Sequence
  Marburg virus siRNA sense strand
ccccucagaagagacgugccg

SEQ ID NO: 28361 - RNA, 21 nt, Artificial Sequence
  Marburg virus siRNA sense strand
cccucagaagagacgugccgu

SEQ ID NO: 28362 - RNA, 21 nt, Artificial Sequence
  Marburg virus siRNA sense strand
ccucagaagagacgugccguu

SEQ ID NO: 28363 - RNA, 21 nt, Artificial Sequence
  Marburg virus siRNA sense strand
cucagaagagacgugccguuc

SEQ ID NO: 28364 - RNA, 21 nt, Artificial Sequence
  Marburg virus siRNA sense strand
ucagaagagacgugccguuca

SEQ ID NO: 28365 - RNA, 21 nt, Artificial Sequence
  Marburg virus siRNA sense strand
cagaagagacgugccguucaa

SEQ ID NO: 28366 - RNA, 21 nt, Artificial Sequence
  Marburg virus siRNA sense strand
agaagagacgugccguucaaa

SEQ ID NO: 28367 - RNA, 21 nt, Artificial Sequence
  Marburg virus siRNA sense strand
gaagagacgugccguucaaag

SEQ ID NO: 28368 - RNA, 21 nt, Artificial Sequence
  Marburg virus siRNA sense strand
aagagacgugccguucaaaga

SEQ ID NO: 28369 - RNA, 21 nt, Artificial Sequence
  Marburg virus siRNA sense strand
agagacgugccguucaaagag

SEQ ID NO: 28370 - RNA, 21 nt, Artificial Sequence
  Marburg virus siRNA sense strand
gagacgugccguucaaagagu

SEQ ID NO: 28371 - RNA, 21 nt, Artificial Sequence
  Marburg virus siRNA sense strand
agacgugccguucaaagaguc

SEQ ID NO: 28372 - RNA, 21 nt, Artificial Sequence
  Marburg virus siRNA sense strand
gacgugccguucaaagagucu

SEQ ID NO: 28373 - RNA, 21 nt, Artificial Sequence
  Marburg virus siRNA sense strand
acgugccguucaaagagucuu

SEQ ID NO: 28374 - RNA, 21 nt, Artificial Sequence
  Marburg virus siRNA sense strand
cgugccguucaaagagucuug

SEQ ID NO: 28375 - RNA, 21 nt, Artificial Sequence
  Marburg virus siRNA sense strand
gugccguucaaagagucuuga

SEQ ID NO: 28376 - RNA, 21 nt, Artificial Sequence
  Marburg virus siRNA sense strand
ugccguucaaagagucuugau

SEQ ID NO: 28377 - RNA, 21 nt, Artificial Sequence
  Marburg virus siRNA sense strand
gccguucaaagagucuugauu

SEQ ID NO: 28378 - RNA, 21 nt, Artificial Sequence
  Marburg virus siRNA sense strand
ccguucaaagagucuugauuu

SEQ ID NO: 28379 - RNA, 21 nt, Artificial Sequence
  Marburg virus siRNA sense strand
cguucaaagagucuugauuua

SEQ ID NO: 28380 - RNA, 21 nt, Artificial Sequence
  Marburg virus siRNA sense strand
guucaaagagucuugauuuau

SEQ ID NO: 28381 - RNA, 21 nt, Artificial Sequence
  Marburg virus siRNA sense strand
uucaaagagucuugauuuaua

SEQ ID NO: 28382 - RNA, 21 nt, Artificial Sequence
  Marburg virus siRNA sense strand
ucaaagagucuugauuuauaa

SEQ ID NO: 28383 - RNA, 21 nt, Artificial Sequence
  Marburg virus siRNA sense strand
caaagagucuugauuuauaac

SEQ ID NO: 28384 - RNA, 21 nt, Artificial Sequence
  Marburg virus siRNA sense strand
aaagagucuugauuuauaacu

SEQ ID NO: 28385 - RNA, 21 nt, Artificial Sequence
  Marburg virus siRNA sense strand
aagagucuugauuuauaacua

SEQ ID NO: 28386 - RNA, 21 nt, Artificial Sequence
  Marburg virus siRNA sense strand
agagucuugauuuauaacuaa

SEQ ID NO: 28387 - RNA, 21 nt, Artificial Sequence
  Marburg virus siRNA sense strand
gagucuugauuuauaacuaac

SEQ ID NO: 28388 - RNA, 21 nt, Artificial Sequence
  Marburg virus siRNA sense strand
agucuugauuuauaacuaacc

SEQ ID NO: 28389 - RNA, 21 nt, Artificial Sequence
  Marburg virus siRNA sense strand
gucuugauuuauaacuaacca

SEQ ID NO: 28390 - RNA, 21 nt, Artificial Sequence
  Marburg virus siRNA sense strand
ucuugauuuauaacuaaccau

SEQ ID NO: 28391 - RNA, 21 nt, Artificial Sequence
  Marburg virus siRNA sense strand
cuugauuuauaacuaaccauu

SEQ ID NO: 28392 - RNA, 21 nt, Artificial Sequence
  Marburg virus siRNA sense strand
uugauuuauaacuaaccauug

SEQ ID NO: 28393 - RNA, 21 nt, Artificial Sequence
  Marburg virus siRNA sense strand
ugauuuauaacuaaccauugu

SEQ ID NO: 28394 - RNA, 21 nt, Artificial Sequence
  Marburg virus siRNA sense strand
gauuuauaacuaaccauugua

SEQ ID NO: 28395 - RNA, 21 nt, Artificial Sequence
  Marburg virus siRNA sense strand
auuuauaacuaaccauuguaa

SEQ ID NO: 28396 - RNA, 21 nt, Artificial Sequence
  Marburg virus siRNA sense strand
uuuauaacuaaccauuguaag

SEQ ID NO: 28397 - RNA, 21 nt, Artificial Sequence
  Marburg virus siRNA sense strand
uuauaacuaaccauuguaaga

SEQ ID NO: 28398 - RNA, 21 nt, Artificial Sequence
  Marburg virus siRNA sense strand
uauaacuaaccauuguaagaa

SEQ ID NO: 28399 - RNA, 21 nt, Artificial Sequence
  Marburg virus siRNA sense strand
auaacuaaccauuguaagaau

SEQ ID NO: 28400 - RNA, 21 nt, Artificial Sequence
  Marburg virus siRNA sense strand
uaacuaaccauuguaagaauu

SEQ ID NO: 28401 - RNA, 21 nt, Artificial Sequence
  Marburg virus siRNA sense strand
aacuaaccauuguaagaauua

SEQ ID NO: 28402 - RNA, 21 nt, Artificial Sequence
  Marburg virus siRNA sense strand
acuaaccauuguaagaauuaa

SEQ ID NO: 28403 - RNA, 21 nt, Artificial Sequence
  Marburg virus siRNA sense strand
cuaaccauuguaagaauuaau

SEQ ID NO: 28404 - RNA, 21 nt, Artificial Sequence
  Marburg virus siRNA sense strand
uaaccauuguaagaauuaauu

SEQ ID NO: 28405 - RNA, 21 nt, Artificial Sequence
  Marburg virus siRNA sense strand
aaccauuguaagaauuaauuu

SEQ ID NO: 28406 - RNA, 21 nt, Artificial Sequence
  Marburg virus siRNA sense strand
accauuguaagaauuaauuua

SEQ ID NO: 28407 - RNA, 21 nt, Artificial Sequence
  Marburg virus siRNA sense strand
ccauuguaagaauuaauuuac

SEQ ID NO: 28408 - RNA, 21 nt, Artificial Sequence
  Marburg virus siRNA sense strand
cauuguaagaauuaauuuacu

SEQ ID NO: 28409 - RNA, 21 nt, Artificial Sequence
  Marburg virus siRNA sense strand
auuguaagaauuaauuuacuc

SEQ ID NO: 28410 - RNA, 21 nt, Artificial Sequence
  Marburg virus siRNA sense strand
uuguaagaauuaauuuacucu

SEQ ID NO: 28411 - RNA, 21 nt, Artificial Sequence
  Marburg virus siRNA sense strand
uguaagaauuaauuuacucuu

SEQ ID NO: 28412 - RNA, 21 nt, Artificial Sequence
  Marburg virus siRNA sense strand
guaagaauuaauuuacucuuu

SEQ ID NO: 28413 - RNA, 21 nt, Artificial Sequence
  Marburg virus siRNA sense strand
uaagaauuaauuuacucuuuc

SEQ ID NO: 28414 - RNA, 21 nt, Artificial Sequence
  Marburg virus siRNA sense strand
aagaauuaauuuacucuuucc

SEQ ID NO: 28415 - RNA, 21 nt, Artificial Sequence
  Marburg virus siRNA sense strand
agaauuaauuuacucuuuccg

SEQ ID NO: 28416 - RNA, 21 nt, Artificial Sequence
  Marburg virus siRNA sense strand
gaauuaauuuacucuuuccgu

SEQ ID NO: 28417 - RNA, 21 nt, Artificial Sequence
  Marburg virus siRNA sense strand
aauuaauuuacucuuuccguu

SEQ ID NO: 28418 - RNA, 21 nt, Artificial Sequence
  Marburg virus siRNA sense strand
auuaauuuacucuuuccguua

SEQ ID NO: 28419 - RNA, 21 nt, Artificial Sequence
  Marburg virus siRNA sense strand
uuaauuuacucuuuccguuau

SEQ ID NO: 28420 - RNA, 21 nt, Artificial Sequence
  Marburg virus siRNA sense strand
uaauuuacucuuuccguuaua

SEQ ID NO: 28421 - RNA, 21 nt, Artificial Sequence
  Marburg virus siRNA sense strand
aauuuacucuuuccguuauac

SEQ ID NO: 28422 - RNA, 21 nt, Artificial Sequence
  Marburg virus siRNA sense strand
auuuacucuuuccguuauacu

SEQ ID NO: 28423 - RNA, 21 nt, Artificial Sequence
  Marburg virus siRNA sense strand
uuuacucuuuccguuauacuu

SEQ ID NO: 28424 - RNA, 21 nt, Artificial Sequence
  Marburg virus siRNA sense strand
uuacucuuuccguuauacuua

SEQ ID NO: 28425 - RNA, 21 nt, Artificial Sequence
  Marburg virus siRNA sense strand
uacucuuuccguuauacuuau

SEQ ID NO: 28426 - RNA, 21 nt, Artificial Sequence
  Marburg virus siRNA sense strand
acucuuuccguuauacuuauc

SEQ ID NO: 28427 - RNA, 21 nt, Artificial Sequence
  Marburg virus siRNA sense strand
cucuuuccguuauacuuaucu

SEQ ID NO: 28428 - RNA, 21 nt, Artificial Sequence
  Marburg virus siRNA sense strand
ucuuuccguuauacuuaucua

SEQ ID NO: 28429 - RNA, 21 nt, Artificial Sequence
  Marburg virus siRNA sense strand
cuuuccguuauacuuaucuac

SEQ ID NO: 28430 - RNA, 21 nt, Artificial Sequence
  Marburg virus siRNA sense strand
uuuccguuauacuuaucuaca

SEQ ID NO: 28431 - RNA, 21 nt, Artificial Sequence
  Marburg virus siRNA sense strand
uuccguuauacuuaucuacau

SEQ ID NO: 28432 - RNA, 21 nt, Artificial Sequence
  Marburg virus siRNA sense strand
uccguuauacuuaucuacauu

SEQ ID NO: 28433 - RNA, 21 nt, Artificial Sequence
  Marburg virus siRNA sense strand
ccguuauacuuaucuacauua

SEQ ID NO: 28434 - RNA, 21 nt, Artificial Sequence
  Marburg virus siRNA sense strand
cguuauacuuaucuacauuaa

SEQ ID NO: 28435 - RNA, 21 nt, Artificial Sequence
  Marburg virus siRNA sense strand
guuauacuuaucuacauuaau

SEQ ID NO: 28436 - RNA, 21 nt, Artificial Sequence
  Marburg virus siRNA sense strand
uuauacuuaucuacauuaauu

SEQ ID NO: 28437 - RNA, 21 nt, Artificial Sequence
  Marburg virus siRNA sense strand
uauacuuaucuacauuaauuc

SEQ ID NO: 28438 - RNA, 21 nt, Artificial Sequence
  Marburg virus siRNA sense strand
auacuuaucuacauuaauucc

SEQ ID NO: 28439 - RNA, 21 nt, Artificial Sequence
  Marburg virus siRNA sense strand
uacuuaucuacauuaauuccu

SEQ ID NO: 28440 - RNA, 21 nt, Artificial Sequence
  Marburg virus siRNA sense strand
acuuaucuacauuaauuccuu

SEQ ID NO: 28441 - RNA, 21 nt, Artificial Sequence
  Marburg virus siRNA sense strand
cuuaucuacauuaauuccuug

SEQ ID NO: 28442 - RNA, 21 nt, Artificial Sequence
  Marburg virus siRNA sense strand
uuaucuacauuaauuccuuga

SEQ ID NO: 28443 - RNA, 21 nt, Artificial Sequence
  Marburg virus siRNA sense strand
uaucuacauuaauuccuugaa

SEQ ID NO: 28444 - RNA, 21 nt, Artificial Sequence
  Marburg virus siRNA sense strand
aucuacauuaauuccuugaau

SEQ ID NO: 28445 - RNA, 21 nt, Artificial Sequence
  Marburg virus siRNA sense strand
ucuacauuaauuccuugaaug

SEQ ID NO: 28446 - RNA, 21 nt, Artificial Sequence
  Marburg virus siRNA sense strand
cuacauuaauuccuugaaugu

SEQ ID NO: 28447 - RNA, 21 nt, Artificial Sequence
  Marburg virus siRNA sense strand
uacauuaauuccuugaauguc

SEQ ID NO: 28448 - RNA, 21 nt, Artificial Sequence
  Marburg virus siRNA sense strand
acauuaauuccuugaaugucc

SEQ ID NO: 28449 - RNA, 21 nt, Artificial Sequence
  Marburg virus siRNA sense strand
cauuaauuccuugaaugucca

SEQ ID NO: 28450 - RNA, 21 nt, Artificial Sequence
  Marburg virus siRNA sense strand
auuaauuccuugaauguccag

SEQ ID NO: 28451 - RNA, 21 nt, Artificial Sequence
  Marburg virus siRNA sense strand
uuaauuccuugaauguccagc

SEQ ID NO: 28452 - RNA, 21 nt, Artificial Sequence
  Marburg virus siRNA sense strand
uaauuccuugaauguccagca

SEQ ID NO: 28453 - RNA, 21 nt, Artificial Sequence
  Marburg virus siRNA sense strand
aauuccuugaauguccagcau

SEQ ID NO: 28454 - RNA, 21 nt, Artificial Sequence
  Marburg virus siRNA sense strand
auuccuugaauguccagcauc

SEQ ID NO: 28455 - RNA, 21 nt, Artificial Sequence
  Marburg virus siRNA sense strand
uuccuugaauguccagcauca

SEQ ID NO: 28456 - RNA, 21 nt, Artificial Sequence
  Marburg virus siRNA sense strand
uccuugaauguccagcaucau

SEQ ID NO: 28457 - RNA, 21 nt, Artificial Sequence
  Marburg virus siRNA sense strand
ccuugaauguccagcaucauu

SEQ ID NO: 28458 - RNA, 21 nt, Artificial Sequence
  Marburg virus siRNA sense strand
cuugaauguccagcaucauua

SEQ ID NO: 28459 - RNA, 21 nt, Artificial Sequence
  Marburg virus siRNA sense strand
uugaauguccagcaucauuaa

SEQ ID NO: 28460 - RNA, 21 nt, Artificial Sequence
  Marburg virus siRNA sense strand
ugaauguccagcaucauuaac

SEQ ID NO: 28461 - RNA, 21 nt, Artificial Sequence
  Marburg virus siRNA sense strand
gaauguccagcaucauuaacg

SEQ ID NO: 28462 - RNA, 21 nt, Artificial Sequence
  Marburg virus siRNA sense strand
aauguccagcaucauuaacga

SEQ ID NO: 28463 - RNA, 21 nt, Artificial Sequence
  Marburg virus siRNA sense strand
auguccagcaucauuaacgac

SEQ ID NO: 28464 - RNA, 21 nt, Artificial Sequence
  Marburg virus siRNA sense strand
uguccagcaucauuaacgacu

SEQ ID NO: 28465 - RNA, 21 nt, Artificial Sequence
  Marburg virus siRNA sense strand
guccagcaucauuaacgacuu

SEQ ID NO: 28466 - RNA, 21 nt, Artificial Sequence
  Marburg virus siRNA sense strand
uccagcaucauuaacgacuug

SEQ ID NO: 28467 - RNA, 21 nt, Artificial Sequence
  Marburg virus siRNA sense strand
ccagcaucauuaacgacuugu

SEQ ID NO: 28468 - RNA, 21 nt, Artificial Sequence
  Marburg virus siRNA sense strand
cagcaucauuaacgacuuguc

SEQ ID NO: 28469 - RNA, 21 nt, Artificial Sequence
  Marburg virus siRNA sense strand
agcaucauuaacgacuugucu

SEQ ID NO: 28470 - RNA, 21 nt, Artificial Sequence
  Marburg virus siRNA sense strand
gcaucauuaacgacuugucuu

SEQ ID NO: 28471 - RNA, 21 nt, Artificial Sequence
  Marburg virus siRNA sense strand
caucauuaacgacuugucuua

SEQ ID NO: 28472 - RNA, 21 nt, Artificial Sequence
  Marburg virus siRNA sense strand
aucauuaacgacuugucuuaa

SEQ ID NO: 28473 - RNA, 21 nt, Artificial Sequence
  Marburg virus siRNA sense strand
ucauuaacgacuugucuuaau

SEQ ID NO: 28474 - RNA, 21 nt, Artificial Sequence
  Marburg virus siRNA sense strand
cauuaacgacuugucuuaauu

SEQ ID NO: 28475 - RNA, 21 nt, Artificial Sequence
  Marburg virus siRNA sense strand
auuaacgacuugucuuaauuc

SEQ ID NO: 28476 - RNA, 21 nt, Artificial Sequence
  Marburg virus siRNA sense strand
uuaacgacuugucuuaauuca

SEQ ID NO: 28477 - RNA, 21 nt, Artificial Sequence
  Marburg virus siRNA sense strand
uaacgacuugucuuaauucaa

SEQ ID NO: 28478 - RNA, 21 nt, Artificial Sequence
  Marburg virus siRNA sense strand
aacgacuugucuuaauucaau

SEQ ID NO: 28479 - RNA, 21 nt, Artificial Sequence
  Marburg virus siRNA sense strand
acgacuugucuuaauucaauc

SEQ ID NO: 28480 - RNA, 21 nt, Artificial Sequence
  Marburg virus siRNA sense strand
cgacuugucuuaauucaaucu

SEQ ID NO: 28481 - RNA, 21 nt, Artificial Sequence
  Marburg virus siRNA sense strand
gacuugucuuaauucaaucuu

SEQ ID NO: 28482 - RNA, 21 nt, Artificial Sequence
  Marburg virus siRNA sense strand
acuugucuuaauucaaucuuu

SEQ ID NO: 28483 - RNA, 21 nt, Artificial Sequence
  Marburg virus siRNA sense strand
cuugucuuaauucaaucuuuu

SEQ ID NO: 28484 - RNA, 21 nt, Artificial Sequence
  Marburg virus siRNA sense strand
uugucuuaauucaaucuuuug

SEQ ID NO: 28485 - RNA, 21 nt, Artificial Sequence
  Marburg virus siRNA sense strand
ugucuuaauucaaucuuuugg

SEQ ID NO: 28486 - RNA, 21 nt, Artificial Sequence
  Marburg virus siRNA sense strand
gucuuaauucaaucuuuugga

SEQ ID NO: 28487 - RNA, 21 nt, Artificial Sequence
  Marburg virus siRNA sense strand
ucuuaauucaaucuuuuggau

SEQ ID NO: 28488 - RNA, 21 nt, Artificial Sequence
  Marburg virus siRNA sense strand
cuuaauucaaucuuuuggaug

SEQ ID NO: 28489 - RNA, 21 nt, Artificial Sequence
  Marburg virus siRNA sense strand
uuaauucaaucuuuuggaugc

SEQ ID NO: 28490 - RNA, 21 nt, Artificial Sequence
  Marburg virus siRNA sense strand
uaauucaaucuuuuggaugca

SEQ ID NO: 28491 - RNA, 21 nt, Artificial Sequence
  Marburg virus siRNA sense strand
aauucaaucuuuuggaugcaa

SEQ ID NO: 28492 - RNA, 21 nt, Artificial Sequence
  Marburg virus siRNA sense strand
auucaaucuuuuggaugcaaa

SEQ ID NO: 28493 - RNA, 21 nt, Artificial Sequence
  Marburg virus siRNA sense strand
uucaaucuuuuggaugcaaac

SEQ ID NO: 28494 - RNA, 21 nt, Artificial Sequence
  Marburg virus siRNA sense strand
ucaaucuuuuggaugcaaacc

SEQ ID NO: 28495 - RNA, 21 nt, Artificial Sequence
  Marburg virus siRNA sense strand
caaucuuuuggaugcaaacca

SEQ ID NO: 28496 - RNA, 21 nt, Artificial Sequence
  Marburg virus siRNA sense strand
aaucuuuuggaugcaaaccau

SEQ ID NO: 28497 - RNA, 21 nt, Artificial Sequence
  Marburg virus siRNA sense strand
aucuuuuggaugcaaaccaua

SEQ ID NO: 28498 - RNA, 21 nt, Artificial Sequence
  Marburg virus siRNA sense strand
ucuuuuggaugcaaaccauaa

SEQ ID NO: 28499 - RNA, 21 nt, Artificial Sequence
  Marburg virus siRNA sense strand
cuuuuggaugcaaaccauaag

SEQ ID NO: 28500 - RNA, 21 nt, Artificial Sequence
  Marburg virus siRNA sense strand
uuuuggaugcaaaccauaagg

SEQ ID NO: 28501 - RNA, 21 nt, Artificial Sequence
  Marburg virus siRNA sense strand
uuuggaugcaaaccauaagga

SEQ ID NO: 28502 - RNA, 21 nt, Artificial Sequence
  Marburg virus siRNA sense strand
uuggaugcaaaccauaaggaa

SEQ ID NO: 28503 - RNA, 21 nt, Artificial Sequence
  Marburg virus siRNA sense strand
uggaugcaaaccauaaggaaa

SEQ ID NO: 28504 - RNA, 21 nt, Artificial Sequence
  Marburg virus siRNA sense strand
ggaugcaaaccauaaggaaaa

SEQ ID NO: 28505 - RNA, 21 nt, Artificial Sequence
  Marburg virus siRNA sense strand
gaugcaaaccauaaggaaaaa

SEQ ID NO: 28506 - RNA, 21 nt, Artificial Sequence
  Marburg virus siRNA sense strand
augcaaaccauaaggaaaaau

SEQ ID NO: 28507 - RNA, 21 nt, Artificial Sequence
  Marburg virus siRNA sense strand
ugcaaaccauaaggaaaaaug

SEQ ID NO: 28508 - RNA, 21 nt, Artificial Sequence
  Marburg virus siRNA sense strand
gcaaaccauaaggaaaaauga

SEQ ID NO: 28509 - RNA, 21 nt, Artificial Sequence
  Marburg virus siRNA sense strand
caaaccauaaggaaaaaugag

SEQ ID NO: 28510 - RNA, 21 nt, Artificial Sequence
  Marburg virus siRNA sense strand
aaaccauaaggaaaaaugagc

SEQ ID NO: 28511 - RNA, 21 nt, Artificial Sequence
  Marburg virus siRNA sense strand
aaccauaaggaaaaaugagcc

SEQ ID NO: 28512 - RNA, 21 nt, Artificial Sequence
  Marburg virus siRNA sense strand
accauaaggaaaaaugagcca

SEQ ID NO: 28513 - RNA, 21 nt, Artificial Sequence
  Marburg virus siRNA sense strand
ccauaaggaaaaaugagccac

SEQ ID NO: 28514 - RNA, 21 nt, Artificial Sequence
  Marburg virus siRNA sense strand
cauaaggaaaaaugagccacu

SEQ ID NO: 28515 - RNA, 21 nt, Artificial Sequence
  Marburg virus siRNA sense strand
auaaggaaaaaugagccacuu

SEQ ID NO: 28516 - RNA, 21 nt, Artificial Sequence
  Marburg virus siRNA sense strand
uaaggaaaaaugagccacuuu

SEQ ID NO: 28517 - RNA, 21 nt, Artificial Sequence
  Marburg virus siRNA sense strand
aaggaaaaaugagccacuuuc

SEQ ID NO: 28518 - RNA, 21 nt, Artificial Sequence
  Marburg virus siRNA sense strand
aggaaaaaugagccacuuucc

SEQ ID NO: 28519 - RNA, 21 nt, Artificial Sequence
  Marburg virus siRNA sense strand
ggaaaaaugagccacuuuccc

SEQ ID NO: 28520 - RNA, 21 nt, Artificial Sequence
  Marburg virus siRNA sense strand
gaaaaaugagccacuuucccu

SEQ ID NO: 28521 - RNA, 21 nt, Artificial Sequence
  Marburg virus siRNA sense strand
aaaaaugagccacuuucccuc

SEQ ID NO: 28522 - RNA, 21 nt, Artificial Sequence
  Marburg virus siRNA sense strand
aaaaugagccacuuucccucu

SEQ ID NO: 28523 - RNA, 21 nt, Artificial Sequence
  Marburg virus siRNA sense strand
aaaugagccacuuucccucua

SEQ ID NO: 28524 - RNA, 21 nt, Artificial Sequence
  Marburg virus siRNA sense strand
aaugagccacuuucccucuac

SEQ ID NO: 28525 - RNA, 21 nt, Artificial Sequence
  Marburg virus siRNA sense strand
augagccacuuucccucuacu

SEQ ID NO: 28526 - RNA, 21 nt, Artificial Sequence
  Marburg virus siRNA sense strand
ugagccacuuucccucuacuc

SEQ ID NO: 28527 - RNA, 21 nt, Artificial Sequence
  Marburg virus siRNA sense strand
gagccacuuucccucuacucu

SEQ ID NO: 28528 - RNA, 21 nt, Artificial Sequence
  Marburg virus siRNA sense strand
agccacuuucccucuacucug

SEQ ID NO: 28529 - RNA, 21 nt, Artificial Sequence
  Marburg virus siRNA sense strand
gccacuuucccucuacucuga

SEQ ID NO: 28530 - RNA, 21 nt, Artificial Sequence
  Marburg virus siRNA sense strand
ccacuuucccucuacucugaa

SEQ ID NO: 28531 - RNA, 21 nt, Artificial Sequence
  Marburg virus siRNA sense strand
cacuuucccucuacucugaac

SEQ ID NO: 28532 - RNA, 21 nt, Artificial Sequence
  Marburg virus siRNA sense strand
acuuucccucuacucugaacu

SEQ ID NO: 28533 - RNA, 21 nt, Artificial Sequence
  Marburg virus siRNA sense strand
cuuucccucuacucugaacua

SEQ ID NO: 28534 - RNA, 21 nt, Artificial Sequence
  Marburg virus siRNA sense strand
uuucccucuacucugaacuaa

SEQ ID NO: 28535 - RNA, 21 nt, Artificial Sequence
  Marburg virus siRNA sense strand
uucccucuacucugaacuaag

SEQ ID NO: 28536 - RNA, 21 nt, Artificial Sequence
  Marburg virus siRNA sense strand
ucccucuacucugaacuaagg

SEQ ID NO: 28537 - RNA, 21 nt, Artificial Sequence
  Marburg virus siRNA sense strand
cccucuacucugaacuaagga

SEQ ID NO: 28538 - RNA, 21 nt, Artificial Sequence
  Marburg virus siRNA sense strand
ccucuacucugaacuaaggaa

SEQ ID NO: 28539 - RNA, 21 nt, Artificial Sequence
  Marburg virus siRNA sense strand
cucuacucugaacuaaggaaa

SEQ ID NO: 28540 - RNA, 21 nt, Artificial Sequence
  Marburg virus siRNA sense strand
ucuacucugaacuaaggaaau

SEQ ID NO: 28541 - RNA, 21 nt, Artificial Sequence
  Marburg virus siRNA sense strand
cuacucugaacuaaggaaauu

SEQ ID NO: 28542 - RNA, 21 nt, Artificial Sequence
  Marburg virus siRNA sense strand
uacucugaacuaaggaaauuu

SEQ ID NO: 28543 - RNA, 21 nt, Artificial Sequence
  Marburg virus siRNA sense strand
acucugaacuaaggaaauuuc

SEQ ID NO: 28544 - RNA, 21 nt, Artificial Sequence
  Marburg virus siRNA sense strand
cucugaacuaaggaaauuucu

SEQ ID NO: 28545 - RNA, 21 nt, Artificial Sequence
  Marburg virus siRNA sense strand
ucugaacuaaggaaauuucuc

SEQ ID NO: 28546 - RNA, 21 nt, Artificial Sequence
  Marburg virus siRNA sense strand
cugaacuaaggaaauuucucu

SEQ ID NO: 28547 - RNA, 21 nt, Artificial Sequence
  Marburg virus siRNA sense strand
ugaacuaaggaaauuucucuu

SEQ ID NO: 28548 - RNA, 21 nt, Artificial Sequence
  Marburg virus siRNA sense strand
gaacuaaggaaauuucucuua

SEQ ID NO: 28549 - RNA, 21 nt, Artificial Sequence
  Marburg virus siRNA sense strand
aacuaaggaaauuucucuuau

SEQ ID NO: 28550 - RNA, 21 nt, Artificial Sequence
  Marburg virus siRNA sense strand
acuaaggaaauuucucuuauc

SEQ ID NO: 28551 - RNA, 21 nt, Artificial Sequence
  Marburg virus siRNA sense strand
cuaaggaaauuucucuuauca

SEQ ID NO: 28552 - RNA, 21 nt, Artificial Sequence
  Marburg virus siRNA sense strand
uaaggaaauuucucuuaucag

SEQ ID NO: 28553 - RNA, 21 nt, Artificial Sequence
  Marburg virus siRNA sense strand
aaggaaauuucucuuaucagc

SEQ ID NO: 28554 - RNA, 21 nt, Artificial Sequence
  Marburg virus siRNA sense strand
aggaaauuucucuuaucagcc

SEQ ID NO: 28555 - RNA, 21 nt, Artificial Sequence
  Marburg virus siRNA sense strand
ggaaauuucucuuaucagccu

SEQ ID NO: 28556 - RNA, 21 nt, Artificial Sequence
  Marburg virus siRNA sense strand
gaaauuucucuuaucagccua

SEQ ID NO: 28557 - RNA, 21 nt, Artificial Sequence
  Marburg virus siRNA sense strand
aaauuucucuuaucagccuaa

SEQ ID NO: 28558 - RNA, 21 nt, Artificial Sequence
  Marburg virus siRNA sense strand
aauuucucuuaucagccuaaa

SEQ ID NO: 28559 - RNA, 21 nt, Artificial Sequence
  Marburg virus siRNA sense strand
auuucucuuaucagccuaaaa

SEQ ID NO: 28560 - RNA, 21 nt, Artificial Sequence
  Marburg virus siRNA sense strand
uuucucuuaucagccuaaaau

SEQ ID NO: 28561 - RNA, 21 nt, Artificial Sequence
  Marburg virus siRNA sense strand
uucucuuaucagccuaaaauc

SEQ ID NO: 28562 - RNA, 21 nt, Artificial Sequence
  Marburg virus siRNA sense strand
ucucuuaucagccuaaaaucu

SEQ ID NO: 28563 - RNA, 21 nt, Artificial Sequence
  Marburg virus siRNA sense strand
cucuuaucagccuaaaaucug

SEQ ID NO: 28564 - RNA, 21 nt, Artificial Sequence
  Marburg virus siRNA sense strand
ucuuaucagccuaaaaucuga

SEQ ID NO: 28565 - RNA, 21 nt, Artificial Sequence
  Marburg virus siRNA sense strand
cuuaucagccuaaaaucugau

SEQ ID NO: 28566 - RNA, 21 nt, Artificial Sequence
  Marburg virus siRNA sense strand
uuaucagccuaaaaucugauc

SEQ ID NO: 28567 - RNA, 21 nt, Artificial Sequence
  Marburg virus siRNA sense strand
uaucagccuaaaaucugaucc

SEQ ID NO: 28568 - RNA, 21 nt, Artificial Sequence
  Marburg virus siRNA sense strand
aucagccuaaaaucugauccg

SEQ ID NO: 28569 - RNA, 21 nt, Artificial Sequence
  Marburg virus siRNA sense strand
ucagccuaaaaucugauccgu

SEQ ID NO: 28570 - RNA, 21 nt, Artificial Sequence
  Marburg virus siRNA sense strand
cagccuaaaaucugauccguu

SEQ ID NO: 28571 - RNA, 21 nt, Artificial Sequence
  Marburg virus siRNA sense strand
agccuaaaaucugauccguua

SEQ ID NO: 28572 - RNA, 21 nt, Artificial Sequence
  Marburg virus siRNA sense strand
gccuaaaaucugauccguuag

SEQ ID NO: 28573 - RNA, 21 nt, Artificial Sequence
  Marburg virus siRNA sense strand
ccuaaaaucugauccguuagg

SEQ ID NO: 28574 - RNA, 21 nt, Artificial Sequence
  Marburg virus siRNA sense strand
cuaaaaucugauccguuaggu

SEQ ID NO: 28575 - RNA, 21 nt, Artificial Sequence
  Marburg virus siRNA sense strand
uaaaaucugauccguuagguc

SEQ ID NO: 28576 - RNA, 21 nt, Artificial Sequence
  Marburg virus siRNA sense strand
aaaaucugauccguuagguca

SEQ ID NO: 28577 - RNA, 21 nt, Artificial Sequence
  Marburg virus siRNA sense strand
aaaucugauccguuaggucau

SEQ ID NO: 28578 - RNA, 21 nt, Artificial Sequence
  Marburg virus siRNA sense strand
aaucugauccguuaggucaug

SEQ ID NO: 28579 - RNA, 21 nt, Artificial Sequence
  Marburg virus siRNA sense strand
aucugauccguuaggucaugg

SEQ ID NO: 28580 - RNA, 21 nt, Artificial Sequence
  Marburg virus siRNA sense strand
ucugauccguuaggucauggg

SEQ ID NO: 28581 - RNA, 21 nt, Artificial Sequence
  Marburg virus siRNA sense strand
cugauccguuaggucaugggc

SEQ ID NO: 28582 - RNA, 21 nt, Artificial Sequence
  Marburg virus siRNA sense strand
ugauccguuaggucaugggcc

SEQ ID NO: 28583 - RNA, 21 nt, Artificial Sequence
  Marburg virus siRNA sense strand
gauccguuaggucaugggccc

SEQ ID NO: 28584 - RNA, 21 nt, Artificial Sequence
  Marburg virus siRNA sense strand
auccguuaggucaugggcccu

SEQ ID NO: 28585 - RNA, 21 nt, Artificial Sequence
  Marburg virus siRNA sense strand
uccguuaggucaugggcccuu

SEQ ID NO: 28586 - RNA, 21 nt, Artificial Sequence
  Marburg virus siRNA sense strand
ccguuaggucaugggcccuuc

SEQ ID NO: 28587 - RNA, 21 nt, Artificial Sequence
  Marburg virus siRNA sense strand
cguuaggucaugggcccuuca

SEQ ID NO: 28588 - RNA, 21 nt, Artificial Sequence
  Marburg virus siRNA sense strand
guuaggucaugggcccuucau

SEQ ID NO: 28589 - RNA, 21 nt, Artificial Sequence
  Marburg virus siRNA sense strand
uuaggucaugggcccuucaua

SEQ ID NO: 28590 - RNA, 21 nt, Artificial Sequence
  Marburg virus siRNA sense strand
uaggucaugggcccuucauaa

SEQ ID NO: 28591 - RNA, 21 nt, Artificial Sequence
  Marburg virus siRNA sense strand
aggucaugggcccuucauaau

SEQ ID NO: 28592 - RNA, 21 nt, Artificial Sequence
  Marburg virus siRNA sense strand
ggucaugggcccuucauaauc

SEQ ID NO: 28593 - RNA, 21 nt, Artificial Sequence
  Marburg virus siRNA sense strand
gucaugggcccuucauaaucu

SEQ ID NO: 28594 - RNA, 21 nt, Artificial Sequence
  Marburg virus siRNA sense strand
ucaugggcccuucauaaucug

SEQ ID NO: 28595 - RNA, 21 nt, Artificial Sequence
  Marburg virus siRNA sense strand
caugggcccuucauaaucugu

SEQ ID NO: 28596 - RNA, 21 nt, Artificial Sequence
  Marburg virus siRNA sense strand
augggcccuucauaaucuguu

SEQ ID NO: 28597 - RNA, 21 nt, Artificial Sequence
  Marburg virus siRNA sense strand
ugggcccuucauaaucuguuu

SEQ ID NO: 28598 - RNA, 21 nt, Artificial Sequence
  Marburg virus siRNA sense strand
gggcccuucauaaucuguuug

SEQ ID NO: 28599 - RNA, 21 nt, Artificial Sequence
  Marburg virus siRNA sense strand
ggcccuucauaaucuguuuga

SEQ ID NO: 28600 - RNA, 21 nt, Artificial Sequence
  Marburg virus siRNA sense strand
gcccuucauaaucuguuugag

SEQ ID NO: 28601 - RNA, 21 nt, Artificial Sequence
  Marburg virus siRNA sense strand
cccuucauaaucuguuugagc

SEQ ID NO: 28602 - RNA, 21 nt, Artificial Sequence
  Marburg virus siRNA sense strand
ccuucauaaucuguuugagca

SEQ ID NO: 28603 - RNA, 21 nt, Artificial Sequence
  Marburg virus siRNA sense strand
cuucauaaucuguuugagcau

SEQ ID NO: 28604 - RNA, 21 nt, Artificial Sequence
  Marburg virus siRNA sense strand
uucauaaucuguuugagcaug

SEQ ID NO: 28605 - RNA, 21 nt, Artificial Sequence
  Marburg virus siRNA sense strand
ucauaaucuguuugagcauga

SEQ ID NO: 28606 - RNA, 21 nt, Artificial Sequence
  Marburg virus siRNA sense strand
cauaaucuguuugagcaugaa

SEQ ID NO: 28607 - RNA, 21 nt, Artificial Sequence
  Marburg virus siRNA sense strand
auaaucuguuugagcaugaau

SEQ ID NO: 28608 - RNA, 21 nt, Artificial Sequence
  Marburg virus siRNA sense strand
uaaucuguuugagcaugaaug

SEQ ID NO: 28609 - RNA, 21 nt, Artificial Sequence
  Marburg virus siRNA sense strand
aaucuguuugagcaugaaugu

SEQ ID NO: 28610 - RNA, 21 nt, Artificial Sequence
  Marburg virus siRNA sense strand
aucuguuugagcaugaauguu

SEQ ID NO: 28611 - RNA, 21 nt, Artificial Sequence
  Marburg virus siRNA sense strand
ucuguuugagcaugaauguug

SEQ ID NO: 28612 - RNA, 21 nt, Artificial Sequence
  Marburg virus siRNA sense strand
cuguuugagcaugaauguuga

SEQ ID NO: 28613 - RNA, 21 nt, Artificial Sequence
  Marburg virus siRNA sense strand
uguuugagcaugaauguugau

SEQ ID NO: 28614 - RNA, 21 nt, Artificial Sequence
  Marburg virus siRNA sense strand
guuugagcaugaauguugauc

SEQ ID NO: 28615 - RNA, 21 nt, Artificial Sequence
  Marburg virus siRNA sense strand
uuugagcaugaauguugauca

SEQ ID NO: 28616 - RNA, 21 nt, Artificial Sequence
  Marburg virus siRNA sense strand
uugagcaugaauguugaucaa

SEQ ID NO: 28617 - RNA, 21 nt, Artificial Sequence
  Marburg virus siRNA sense strand
ugagcaugaauguugaucaaa

SEQ ID NO: 28618 - RNA, 21 nt, Artificial Sequence
  Marburg virus siRNA sense strand
gagcaugaauguugaucaaau

SEQ ID NO: 28619 - RNA, 21 nt, Artificial Sequence
  Marburg virus siRNA sense strand
agcaugaauguugaucaaaug

SEQ ID NO: 28620 - RNA, 21 nt, Artificial Sequence
  Marburg virus siRNA sense strand
gcaugaauguugaucaaauga

SEQ ID NO: 28621 - RNA, 21 nt, Artificial Sequence
  Marburg virus siRNA sense strand
caugaauguugaucaaaugac

SEQ ID NO: 28622 - RNA, 21 nt, Artificial Sequence
  Marburg virus siRNA sense strand
augaauguugaucaaaugacc

SEQ ID NO: 28623 - RNA, 21 nt, Artificial Sequence
  Marburg virus siRNA sense strand
ugaauguugaucaaaugacca

SEQ ID NO: 28624 - RNA, 21 nt, Artificial Sequence
  Marburg virus siRNA sense strand
gaauguugaucaaaugaccaa

SEQ ID NO: 28625 - RNA, 21 nt, Artificial Sequence
  Marburg virus siRNA sense strand
aauguugaucaaaugaccaaa

SEQ ID NO: 28626 - RNA, 21 nt, Artificial Sequence
  Marburg virus siRNA sense strand
auguugaucaaaugaccaaau

SEQ ID NO: 28627 - RNA, 21 nt, Artificial Sequence
  Marburg virus siRNA sense strand
uguugaucaaaugaccaaaua

SEQ ID NO: 28628 - RNA, 21 nt, Artificial Sequence
  Marburg virus siRNA sense strand
guugaucaaaugaccaaauaa

SEQ ID NO: 28629 - RNA, 21 nt, Artificial Sequence
  Marburg virus siRNA sense strand
uugaucaaaugaccaaauaau

SEQ ID NO: 28630 - RNA, 21 nt, Artificial Sequence
  Marburg virus siRNA sense strand
ugaucaaaugaccaaauaaua

SEQ ID NO: 28631 - RNA, 21 nt, Artificial Sequence
  Marburg virus siRNA sense strand
gaucaaaugaccaaauaauag

SEQ ID NO: 28632 - RNA, 21 nt, Artificial Sequence
  Marburg virus siRNA sense strand
aucaaaugaccaaauaauagu

SEQ ID NO: 28633 - RNA, 21 nt, Artificial Sequence
  Marburg virus siRNA sense strand
ucaaaugaccaaauaauagug

SEQ ID NO: 28634 - RNA, 21 nt, Artificial Sequence
  Marburg virus siRNA sense strand
caaaugaccaaauaauagugc

SEQ ID NO: 28635 - RNA, 21 nt, Artificial Sequence
  Marburg virus siRNA sense strand
aaaugaccaaauaauagugca

SEQ ID NO: 28636 - RNA, 21 nt, Artificial Sequence
  Marburg virus siRNA sense strand
aaugaccaaauaauagugcau

SEQ ID NO: 28637 - RNA, 21 nt, Artificial Sequence
  Marburg virus siRNA sense strand
augaccaaauaauagugcauu

SEQ ID NO: 28638 - RNA, 21 nt, Artificial Sequence
  Marburg virus siRNA sense strand
ugaccaaauaauagugcauuu

SEQ ID NO: 28639 - RNA, 21 nt, Artificial Sequence
  Marburg virus siRNA sense strand
gaccaaauaauagugcauuug

SEQ ID NO: 28640 - RNA, 21 nt, Artificial Sequence
  Marburg virus siRNA sense strand
accaaauaauagugcauuugu

SEQ ID NO: 28641 - RNA, 21 nt, Artificial Sequence
  Marburg virus siRNA sense strand
ccaaauaauagugcauuugua

SEQ ID NO: 28642 - RNA, 21 nt, Artificial Sequence
  Marburg virus siRNA sense strand
caaauaauagugcauuuguau

SEQ ID NO: 28643 - RNA, 21 nt, Artificial Sequence
  Marburg virus siRNA sense strand
aaauaauagugcauuuguaua

SEQ ID NO: 28644 - RNA, 21 nt, Artificial Sequence
  Marburg virus siRNA sense strand
aauaauagugcauuuguauag

SEQ ID NO: 28645 - RNA, 21 nt, Artificial Sequence
  Marburg virus siRNA sense strand
auaauagugcauuuguauaga

SEQ ID NO: 28646 - RNA, 21 nt, Artificial Sequence
  Marburg virus siRNA sense strand
uaauagugcauuuguauagau

SEQ ID NO: 28647 - RNA, 21 nt, Artificial Sequence
  Marburg virus siRNA sense strand
aauagugcauuuguauagauu

SEQ ID NO: 28648 - RNA, 21 nt, Artificial Sequence
  Marburg virus siRNA sense strand
auagugcauuuguauagauuc

SEQ ID NO: 28649 - RNA, 21 nt, Artificial Sequence
  Marburg virus siRNA sense strand
uagugcauuuguauagauuca

SEQ ID NO: 28650 - RNA, 21 nt, Artificial Sequence
  Marburg virus siRNA sense strand
agugcauuuguauagauucaa

SEQ ID NO: 28651 - RNA, 21 nt, Artificial Sequence
  Marburg virus siRNA sense strand
gugcauuuguauagauucaau

SEQ ID NO: 28652 - RNA, 21 nt, Artificial Sequence
  Marburg virus siRNA sense strand
ugcauuuguauagauucaauu

SEQ ID NO: 28653 - RNA, 21 nt, Artificial Sequence
  Marburg virus siRNA sense strand
gcauuuguauagauucaauua

SEQ ID NO: 28654 - RNA, 21 nt, Artificial Sequence
  Marburg virus siRNA sense strand
cauuuguauagauucaauuau

SEQ ID NO: 28655 - RNA, 21 nt, Artificial Sequence
  Marburg virus siRNA sense strand
auuuguauagauucaauuauc

SEQ ID NO: 28656 - RNA, 21 nt, Artificial Sequence
  Marburg virus siRNA sense strand
uuuguauagauucaauuaucc

SEQ ID NO: 28657 - RNA, 21 nt, Artificial Sequence
  Marburg virus siRNA sense strand
uuguauagauucaauuauccu

SEQ ID NO: 28658 - RNA, 21 nt, Artificial Sequence
  Marburg virus siRNA sense strand
uguauagauucaauuauccuu

SEQ ID NO: 28659 - RNA, 21 nt, Artificial Sequence
  Marburg virus siRNA sense strand
guauagauucaauuauccuuu

SEQ ID NO: 28660 - RNA, 21 nt, Artificial Sequence
  Marburg virus siRNA sense strand
uauagauucaauuauccuuua

SEQ ID NO: 28661 - RNA, 21 nt, Artificial Sequence
  Marburg virus siRNA sense strand
auagauucaauuauccuuuau

SEQ ID NO: 28662 - RNA, 21 nt, Artificial Sequence
  Marburg virus siRNA sense strand
uagauucaauuauccuuuauu

SEQ ID NO: 28663 - RNA, 21 nt, Artificial Sequence
  Marburg virus siRNA sense strand
agauucaauuauccuuuauua

SEQ ID NO: 28664 - RNA, 21 nt, Artificial Sequence
  Marburg virus siRNA sense strand
gauucaauuauccuuuauuaa

SEQ ID NO: 28665 - RNA, 21 nt, Artificial Sequence
  Marburg virus siRNA sense strand
auucaauuauccuuuauuaag

SEQ ID NO: 28666 - RNA, 21 nt, Artificial Sequence
  Marburg virus siRNA sense strand
uucaauuauccuuuauuaaga

SEQ ID NO: 28667 - RNA, 21 nt, Artificial Sequence
  Marburg virus siRNA sense strand
ucaauuauccuuuauuaagaa

SEQ ID NO: 28668 - RNA, 21 nt, Artificial Sequence
  Marburg virus siRNA sense strand
caauuauccuuuauuaagaaa

SEQ ID NO: 28669 - RNA, 21 nt, Artificial Sequence
  Marburg virus siRNA sense strand
aauuauccuuuauuaagaaaa

SEQ ID NO: 28670 - RNA, 21 nt, Artificial Sequence
  Marburg virus siRNA sense strand
auuauccuuuauuaagaaaaa

SEQ ID NO: 28671 - RNA, 21 nt, Artificial Sequence
  Marburg virus siRNA sense strand
uuauccuuuauuaagaaaaag

SEQ ID NO: 28672 - RNA, 21 nt, Artificial Sequence
  Marburg virus siRNA sense strand
uauccuuuauuaagaaaaaga

SEQ ID NO: 28673 - RNA, 21 nt, Artificial Sequence
  Marburg virus siRNA sense strand
auccuuuauuaagaaaaagau

SEQ ID NO: 28674 - RNA, 21 nt, Artificial Sequence
  Marburg virus siRNA sense strand
uccuuuauuaagaaaaagaua

SEQ ID NO: 28675 - RNA, 21 nt, Artificial Sequence
  Marburg virus siRNA sense strand
ccuuuauuaagaaaaagauag

SEQ ID NO: 28676 - RNA, 21 nt, Artificial Sequence
  Marburg virus siRNA sense strand
cuuuauuaagaaaaagauaga

SEQ ID NO: 28677 - RNA, 21 nt, Artificial Sequence
  Marburg virus siRNA sense strand
uuuauuaagaaaaagauagac

SEQ ID NO: 28678 - RNA, 21 nt, Artificial Sequence
  Marburg virus siRNA sense strand
uuauuaagaaaaagauagaca

SEQ ID NO: 28679 - RNA, 21 nt, Artificial Sequence
  Marburg virus siRNA sense strand
uauuaagaaaaagauagacag

SEQ ID NO: 28680 - RNA, 21 nt, Artificial Sequence
  Marburg virus siRNA sense strand
auuaagaaaaagauagacaga

SEQ ID NO: 28681 - RNA, 21 nt, Artificial Sequence
  Marburg virus siRNA sense strand
uuaagaaaaagauagacagaa

SEQ ID NO: 28682 - RNA, 21 nt, Artificial Sequence
  Marburg virus siRNA sense strand
uaagaaaaagauagacagaac

SEQ ID NO: 28683 - RNA, 21 nt, Artificial Sequence
  Marburg virus siRNA sense strand
aagaaaaagauagacagaaca

SEQ ID NO: 28684 - RNA, 21 nt, Artificial Sequence
  Marburg virus siRNA sense strand
agaaaaagauagacagaacac

SEQ ID NO: 28685 - RNA, 21 nt, Artificial Sequence
  Marburg virus siRNA sense strand
gaaaaagauagacagaacaca

SEQ ID NO: 28686 - RNA, 21 nt, Artificial Sequence
  Marburg virus siRNA sense strand
aaaaagauagacagaacacaa

SEQ ID NO: 28687 - RNA, 21 nt, Artificial Sequence
  Marburg virus siRNA sense strand
aaaagauagacagaacacaaa

SEQ ID NO: 28688 - RNA, 21 nt, Artificial Sequence
  Marburg virus siRNA sense strand
aaagauagacagaacacaaag

SEQ ID NO: 28689 - RNA, 21 nt, Artificial Sequence
  Marburg virus siRNA sense strand
aagauagacagaacacaaaga

SEQ ID NO: 28690 - RNA, 21 nt, Artificial Sequence
  Marburg virus siRNA sense strand
agauagacagaacacaaagaa

SEQ ID NO: 28691 - RNA, 21 nt, Artificial Sequence
  Marburg virus siRNA sense strand
gauagacagaacacaaagaau

SEQ ID NO: 28692 - RNA, 21 nt, Artificial Sequence
  Marburg virus siRNA sense strand
auagacagaacacaaagaauu

SEQ ID NO: 28693 - RNA, 21 nt, Artificial Sequence
  Marburg virus siRNA sense strand
uagacagaacacaaagaauug

SEQ ID NO: 28694 - RNA, 21 nt, Artificial Sequence
  Marburg virus siRNA sense strand
agacagaacacaaagaauuga

SEQ ID NO: 28695 - RNA, 21 nt, Artificial Sequence
  Marburg virus siRNA sense strand
gacagaacacaaagaauugau

SEQ ID NO: 28696 - RNA, 21 nt, Artificial Sequence
  Marburg virus siRNA sense strand
acagaacacaaagaauugaua

SEQ ID NO: 28697 - RNA, 21 nt, Artificial Sequence
  Marburg virus siRNA sense strand
cagaacacaaagaauugauaa

SEQ ID NO: 28698 - RNA, 21 nt, Artificial Sequence
  Marburg virus siRNA sense strand
agaacacaaagaauugauaaa

SEQ ID NO: 28699 - RNA, 21 nt, Artificial Sequence
  Marburg virus siRNA sense strand
gaacacaaagaauugauaaaa

SEQ ID NO: 28700 - RNA, 21 nt, Artificial Sequence
  Marburg virus siRNA sense strand
aacacaaagaauugauaaaau

SEQ ID NO: 28701 - RNA, 21 nt, Artificial Sequence
  Marburg virus siRNA sense strand
acacaaagaauugauaaaaua

SEQ ID NO: 28702 - RNA, 21 nt, Artificial Sequence
  Marburg virus siRNA sense strand
cacaaagaauugauaaaauau

SEQ ID NO: 28703 - RNA, 21 nt, Artificial Sequence
  Marburg virus siRNA sense strand
acaaagaauugauaaaauauu

SEQ ID NO: 28704 - RNA, 21 nt, Artificial Sequence
  Marburg virus siRNA sense strand
caaagaauugauaaaauauua

SEQ ID NO: 28705 - RNA, 21 nt, Artificial Sequence
  Marburg virus siRNA sense strand
aaagaauugauaaaauauuac

SEQ ID NO: 28706 - RNA, 21 nt, Artificial Sequence
  Marburg virus siRNA sense strand
aagaauugauaaaauauuacu

SEQ ID NO: 28707 - RNA, 21 nt, Artificial Sequence
  Marburg virus siRNA sense strand
agaauugauaaaauauuacuu

SEQ ID NO: 28708 - RNA, 21 nt, Artificial Sequence
  Marburg virus siRNA sense strand
gaauugauaaaauauuacuuu

SEQ ID NO: 28709 - RNA, 21 nt, Artificial Sequence
  Marburg virus siRNA sense strand
aauugauaaaauauuacuuug

SEQ ID NO: 28710 - RNA, 21 nt, Artificial Sequence
  Marburg virus siRNA sense strand
auugauaaaauauuacuuuga

SEQ ID NO: 28711 - RNA, 21 nt, Artificial Sequence
  Marburg virus siRNA sense strand
uugauaaaauauuacuuugau

SEQ ID NO: 28712 - RNA, 21 nt, Artificial Sequence
  Marburg virus siRNA sense strand
ugauaaaauauuacuuugauc

SEQ ID NO: 28713 - RNA, 21 nt, Artificial Sequence
  Marburg virus siRNA sense strand
gauaaaauauuacuuugauca

SEQ ID NO: 28714 - RNA, 21 nt, Artificial Sequence
  Marburg virus siRNA sense strand
auaaaauauuacuuugaucaa

SEQ ID NO: 28715 - RNA, 21 nt, Artificial Sequence
  Marburg virus siRNA sense strand
uaaaauauuacuuugaucaau

SEQ ID NO: 28716 - RNA, 21 nt, Artificial Sequence
  Marburg virus siRNA sense strand
aaaauauuacuuugaucaauu

SEQ ID NO: 28717 - RNA, 21 nt, Artificial Sequence
  Marburg virus siRNA sense strand
aaauauuacuuugaucaauuu

SEQ ID NO: 28718 - RNA, 21 nt, Artificial Sequence
  Marburg virus siRNA sense strand
aauauuacuuugaucaauuuu

SEQ ID NO: 28719 - RNA, 21 nt, Artificial Sequence
  Marburg virus siRNA sense strand
auauuacuuugaucaauuuug

SEQ ID NO: 28720 - RNA, 21 nt, Artificial Sequence
  Marburg virus siRNA sense strand
uauuacuuugaucaauuuugc

SEQ ID NO: 28721 - RNA, 21 nt, Artificial Sequence
  Marburg virus siRNA sense strand
auuacuuugaucaauuuugcg

SEQ ID NO: 28722 - RNA, 21 nt, Artificial Sequence
  Marburg virus siRNA sense strand
uuacuuugaucaauuuugcga

SEQ ID NO: 28723 - RNA, 21 nt, Artificial Sequence
  Marburg virus siRNA sense strand
uacuuugaucaauuuugcgag

SEQ ID NO: 28724 - RNA, 21 nt, Artificial Sequence
  Marburg virus siRNA sense strand
acuuugaucaauuuugcgagg

SEQ ID NO: 28725 - RNA, 21 nt, Artificial Sequence
  Marburg virus siRNA sense strand
cuuugaucaauuuugcgagga

SEQ ID NO: 28726 - RNA, 21 nt, Artificial Sequence
  Marburg virus siRNA sense strand
uuugaucaauuuugcgaggaa

SEQ ID NO: 28727 - RNA, 21 nt, Artificial Sequence
  Marburg virus siRNA sense strand
uugaucaauuuugcgaggaau

SEQ ID NO: 28728 - RNA, 21 nt, Artificial Sequence
  Marburg virus siRNA sense strand
ugaucaauuuugcgaggaauu

SEQ ID NO: 28729 - RNA, 21 nt, Artificial Sequence
  Marburg virus siRNA sense strand
gaucaauuuugcgaggaauua

SEQ ID NO: 28730 - RNA, 21 nt, Artificial Sequence
  Marburg virus siRNA sense strand
aucaauuuugcgaggaauuau

SEQ ID NO: 28731 - RNA, 21 nt, Artificial Sequence
  Marburg virus siRNA sense strand
ucaauuuugcgaggaauuaua

SEQ ID NO: 28732 - RNA, 21 nt, Artificial Sequence
  Marburg virus siRNA sense strand
caauuuugcgaggaauuauaa

SEQ ID NO: 28733 - RNA, 21 nt, Artificial Sequence
  Marburg virus siRNA sense strand
aauuuugcgaggaauuauaaa

SEQ ID NO: 28734 - RNA, 21 nt, Artificial Sequence
  Marburg virus siRNA sense strand
auuuugcgaggaauuauaaaa

SEQ ID NO: 28735 - RNA, 21 nt, Artificial Sequence
  Marburg virus siRNA sense strand
uuuugcgaggaauuauaaaaa

SEQ ID NO: 28736 - RNA, 21 nt, Artificial Sequence
  Marburg virus siRNA sense strand
uuugcgaggaauuauaaaaau

SEQ ID NO: 28737 - RNA, 21 nt, Artificial Sequence
  Marburg virus siRNA sense strand
uugcgaggaauuauaaaaauc

SEQ ID NO: 28738 - RNA, 21 nt, Artificial Sequence
  Marburg virus siRNA sense strand
ugcgaggaauuauaaaaaucu

SEQ ID NO: 28739 - RNA, 21 nt, Artificial Sequence
  Marburg virus siRNA sense strand
gcgaggaauuauaaaaaucuu

SEQ ID NO: 28740 - RNA, 21 nt, Artificial Sequence
  Marburg virus siRNA sense strand
cgaggaauuauaaaaaucuug

SEQ ID NO: 28741 - RNA, 21 nt, Artificial Sequence
  Marburg virus siRNA sense strand
gaggaauuauaaaaaucuuga

SEQ ID NO: 28742 - RNA, 21 nt, Artificial Sequence
  Marburg virus siRNA sense strand
aggaauuauaaaaaucuugag

SEQ ID NO: 28743 - RNA, 21 nt, Artificial Sequence
  Marburg virus siRNA sense strand
ggaauuauaaaaaucuugagg

SEQ ID NO: 28744 - RNA, 21 nt, Artificial Sequence
  Marburg virus siRNA sense strand
gaauuauaaaaaucuugaggg

SEQ ID NO: 28745 - RNA, 21 nt, Artificial Sequence
  Marburg virus siRNA sense strand
aauuauaaaaaucuugaggga

SEQ ID NO: 28746 - RNA, 21 nt, Artificial Sequence
  Marburg virus siRNA sense strand
auuauaaaaaucuugagggac

SEQ ID NO: 28747 - RNA, 21 nt, Artificial Sequence
  Marburg virus siRNA sense strand
uuauaaaaaucuugagggaca

SEQ ID NO: 28748 - RNA, 21 nt, Artificial Sequence
  Marburg virus siRNA sense strand
uauaaaaaucuugagggacaa

SEQ ID NO: 28749 - RNA, 21 nt, Artificial Sequence
  Marburg virus siRNA sense strand
auaaaaaucuugagggacaaa

SEQ ID NO: 28750 - RNA, 21 nt, Artificial Sequence
  Marburg virus siRNA sense strand
uaaaaaucuugagggacaaau

SEQ ID NO: 28751 - RNA, 21 nt, Artificial Sequence
  Marburg virus siRNA sense strand
aaaaaucuugagggacaaauu

SEQ ID NO: 28752 - RNA, 21 nt, Artificial Sequence
  Marburg virus siRNA sense strand
aaaaucuugagggacaaauua

SEQ ID NO: 28753 - RNA, 21 nt, Artificial Sequence
  Marburg virus siRNA sense strand
aaaucuugagggacaaauuau

SEQ ID NO: 28754 - RNA, 21 nt, Artificial Sequence
  Marburg virus siRNA sense strand
aaucuugagggacaaauuauu

SEQ ID NO: 28755 - RNA, 21 nt, Artificial Sequence
  Marburg virus siRNA sense strand
aucuugagggacaaauuauug

SEQ ID NO: 28756 - RNA, 21 nt, Artificial Sequence
  Marburg virus siRNA sense strand
ucuugagggacaaauuauugu

SEQ ID NO: 28757 - RNA, 21 nt, Artificial Sequence
  Marburg virus siRNA sense strand
cuugagggacaaauuauugua

SEQ ID NO: 28758 - RNA, 21 nt, Artificial Sequence
  Marburg virus siRNA sense strand
uugagggacaaauuauuguaa

SEQ ID NO: 28759 - RNA, 21 nt, Artificial Sequence
  Marburg virus siRNA sense strand
ugagggacaaauuauuguaac

SEQ ID NO: 28760 - RNA, 21 nt, Artificial Sequence
  Marburg virus siRNA sense strand
gagggacaaauuauuguaacg

SEQ ID NO: 28761 - RNA, 21 nt, Artificial Sequence
  Marburg virus siRNA sense strand
agggacaaauuauuguaacgu

SEQ ID NO: 28762 - RNA, 21 nt, Artificial Sequence
  Marburg virus siRNA sense strand
gggacaaauuauuguaacgua

SEQ ID NO: 28763 - RNA, 21 nt, Artificial Sequence
  Marburg virus siRNA sense strand
ggacaaauuauuguaacguag

SEQ ID NO: 28764 - RNA, 21 nt, Artificial Sequence
  Marburg virus siRNA sense strand
gacaaauuauuguaacguaga

SEQ ID NO: 28765 - RNA, 21 nt, Artificial Sequence
  Marburg virus siRNA sense strand
acaaauuauuguaacguagag

SEQ ID NO: 28766 - RNA, 21 nt, Artificial Sequence
  Marburg virus siRNA sense strand
caaauuauuguaacguagagu

SEQ ID NO: 28767 - RNA, 21 nt, Artificial Sequence
  Marburg virus siRNA sense strand
aaauuauuguaacguagaguc

SEQ ID NO: 28768 - RNA, 21 nt, Artificial Sequence
  Marburg virus siRNA sense strand
aauuauuguaacguagagucg

SEQ ID NO: 28769 - RNA, 21 nt, Artificial Sequence
  Marburg virus siRNA sense strand
auuauuguaacguagagucga

SEQ ID NO: 28770 - RNA, 21 nt, Artificial Sequence
  Marburg virus siRNA sense strand
uuauuguaacguagagucgaa

SEQ ID NO: 28771 - RNA, 21 nt, Artificial Sequence
  Marburg virus siRNA sense strand
uauuguaacguagagucgaag

SEQ ID NO: 28772 - RNA, 21 nt, Artificial Sequence
  Marburg virus siRNA sense strand
auuguaacguagagucgaaga

SEQ ID NO: 28773 - RNA, 21 nt, Artificial Sequence
  Marburg virus siRNA sense strand
uuguaacguagagucgaagaa

SEQ ID NO: 28774 - RNA, 21 nt, Artificial Sequence
  Marburg virus siRNA sense strand
uguaacguagagucgaagaac

SEQ ID NO: 28775 - RNA, 21 nt, Artificial Sequence
  Marburg virus siRNA sense strand
guaacguagagucgaagaaca

SEQ ID NO: 28776 - RNA, 21 nt, Artificial Sequence
  Marburg virus siRNA sense strand
uaacguagagucgaagaacau

SEQ ID NO: 28777 - RNA, 21 nt, Artificial Sequence
  Marburg virus siRNA sense strand
aacguagagucgaagaacauu

SEQ ID NO: 28778 - RNA, 21 nt, Artificial Sequence
  Marburg virus siRNA sense strand
acguagagucgaagaacauua

SEQ ID NO: 28779 - RNA, 21 nt, Artificial Sequence
  Marburg virus siRNA sense strand
cguagagucgaagaacauuaa

SEQ ID NO: 28780 - RNA, 21 nt, Artificial Sequence
  Marburg virus siRNA sense strand
guagagucgaagaacauuaag

SEQ ID NO: 28781 - RNA, 21 nt, Artificial Sequence
  Marburg virus siRNA sense strand
uagagucgaagaacauuaagu

SEQ ID NO: 28782 - RNA, 21 nt, Artificial Sequence
  Marburg virus siRNA sense strand
agagucgaagaacauuaagug

SEQ ID NO: 28783 - RNA, 21 nt, Artificial Sequence
  Marburg virus siRNA sense strand
gagucgaagaacauuaagugu

SEQ ID NO: 28784 - RNA, 21 nt, Artificial Sequence
  Marburg virus siRNA sense strand
agucgaagaacauuaaguguu

SEQ ID NO: 28785 - RNA, 21 nt, Artificial Sequence
  Marburg virus siRNA sense strand
gucgaagaacauuaaguguuc

SEQ ID NO: 28786 - RNA, 21 nt, Artificial Sequence
  Marburg virus siRNA sense strand
ucgaagaacauuaaguguucu

SEQ ID NO: 28787 - RNA, 21 nt, Artificial Sequence
  Marburg virus siRNA sense strand
cgaagaacauuaaguguucuu

SEQ ID NO: 28788 - RNA, 21 nt, Artificial Sequence
  Marburg virus siRNA sense strand
gaagaacauuaaguguucuuu

SEQ ID NO: 28789 - RNA, 21 nt, Artificial Sequence
  Marburg virus siRNA sense strand
aagaacauuaaguguucuuug

SEQ ID NO: 28790 - RNA, 21 nt, Artificial Sequence
  Marburg virus siRNA sense strand
agaacauuaaguguucuuugu

SEQ ID NO: 28791 - RNA, 21 nt, Artificial Sequence
  Marburg virus siRNA sense strand
gaacauuaaguguucuuuguu

SEQ ID NO: 28792 - RNA, 21 nt, Artificial Sequence
  Marburg virus siRNA sense strand
aacauuaaguguucuuuguua

SEQ ID NO: 28793 - RNA, 21 nt, Artificial Sequence
  Marburg virus siRNA sense strand
acauuaaguguucuuuguuag

SEQ ID NO: 28794 - RNA, 21 nt, Artificial Sequence
  Marburg virus siRNA sense strand
cauuaaguguucuuuguuaga

SEQ ID NO: 28795 - RNA, 21 nt, Artificial Sequence
  Marburg virus siRNA sense strand
auuaaguguucuuuguuagaa

SEQ ID NO: 28796 - RNA, 21 nt, Artificial Sequence
  Marburg virus siRNA sense strand
uuaaguguucuuuguuagaau

SEQ ID NO: 28797 - RNA, 21 nt, Artificial Sequence
  Marburg virus siRNA sense strand
uaaguguucuuuguuagaauu

SEQ ID NO: 28798 - RNA, 21 nt, Artificial Sequence
  Marburg virus siRNA sense strand
aaguguucuuuguuagaauua

SEQ ID NO: 28799 - RNA, 21 nt, Artificial Sequence
  Marburg virus siRNA sense strand
aguguucuuuguuagaauuau

SEQ ID NO: 28800 - RNA, 21 nt, Artificial Sequence
  Marburg virus siRNA sense strand
guguucuuuguuagaauuauu

SEQ ID NO: 28801 - RNA, 21 nt, Artificial Sequence
  Marburg virus siRNA sense strand
uguucuuuguuagaauuauuc

SEQ ID NO: 28802 - RNA, 21 nt, Artificial Sequence
  Marburg virus siRNA sense strand
guucuuuguuagaauuauuca

SEQ ID NO: 28803 - RNA, 21 nt, Artificial Sequence
  Marburg virus siRNA sense strand
uucuuuguuagaauuauucau

SEQ ID NO: 28804 - RNA, 21 nt, Artificial Sequence
  Marburg virus siRNA sense strand
ucuuuguuagaauuauucauc

SEQ ID NO: 28805 - RNA, 21 nt, Artificial Sequence
  Marburg virus siRNA sense strand
cuuuguuagaauuauucaucc

SEQ ID NO: 28806 - RNA, 21 nt, Artificial Sequence
  Marburg virus siRNA sense strand
uuuguuagaauuauucaucca

SEQ ID NO: 28807 - RNA, 21 nt, Artificial Sequence
  Marburg virus siRNA sense strand
uuguuagaauuauucauccaa

SEQ ID NO: 28808 - RNA, 21 nt, Artificial Sequence
  Marburg virus siRNA sense strand
uguuagaauuauucauccaag

SEQ ID NO: 28809 - RNA, 21 nt, Artificial Sequence
  Marburg virus siRNA sense strand
guuagaauuauucauccaagu

SEQ ID NO: 28810 - RNA, 21 nt, Artificial Sequence
  Marburg virus siRNA sense strand
uuagaauuauucauccaaguu

SEQ ID NO: 28811 - RNA, 21 nt, Artificial Sequence
  Marburg virus siRNA sense strand
uagaauuauucauccaaguug

SEQ ID NO: 28812 - RNA, 21 nt, Artificial Sequence
  Marburg virus siRNA sense strand
agaauuauucauccaaguugu

SEQ ID NO: 28813 - RNA, 21 nt, Artificial Sequence
  Marburg virus siRNA sense strand
gaauuauucauccaaguuguu

SEQ ID NO: 28814 - RNA, 21 nt, Artificial Sequence
  Marburg virus siRNA sense strand
aauuauucauccaaguuguuu

SEQ ID NO: 28815 - RNA, 21 nt, Artificial Sequence
  Marburg virus siRNA sense strand
auuauucauccaaguuguuuu

SEQ ID NO: 28816 - RNA, 21 nt, Artificial Sequence
  Marburg virus siRNA sense strand
uuauucauccaaguuguuuug

SEQ ID NO: 28817 - RNA, 21 nt, Artificial Sequence
  Marburg virus siRNA sense strand
uauucauccaaguuguuuuga

SEQ ID NO: 28818 - RNA, 21 nt, Artificial Sequence
  Marburg virus siRNA sense strand
auucauccaaguuguuuugag

SEQ ID NO: 28819 - RNA, 21 nt, Artificial Sequence
  Marburg virus siRNA sense strand
uucauccaaguuguuuugagu

SEQ ID NO: 28820 - RNA, 21 nt, Artificial Sequence
  Marburg virus siRNA sense strand
ucauccaaguuguuuugagua

SEQ ID NO: 28821 - RNA, 21 nt, Artificial Sequence
  Marburg virus siRNA sense strand
cauccaaguuguuuugaguau

SEQ ID NO: 28822 - RNA, 21 nt, Artificial Sequence
  Marburg virus siRNA sense strand
auccaaguuguuuugaguaua

SEQ ID NO: 28823 - RNA, 21 nt, Artificial Sequence
  Marburg virus siRNA sense strand
uccaaguuguuuugaguauac

SEQ ID NO: 28824 - RNA, 21 nt, Artificial Sequence
  Marburg virus siRNA sense strand
ccaaguuguuuugaguauacu

SEQ ID NO: 28825 - RNA, 21 nt, Artificial Sequence
  Marburg virus siRNA sense strand
caaguuguuuugaguauacuc

SEQ ID NO: 28826 - RNA, 21 nt, Artificial Sequence
  Marburg virus siRNA sense strand
aaguuguuuugaguauacucg

SEQ ID NO: 28827 - RNA, 21 nt, Artificial Sequence
  Marburg virus siRNA sense strand
aguuguuuugaguauacucgc

SEQ ID NO: 28828 - RNA, 21 nt, Artificial Sequence
  Marburg virus siRNA sense strand
guuguuuugaguauacucgcu

SEQ ID NO: 28829 - RNA, 21 nt, Artificial Sequence
  Marburg virus siRNA sense strand
uuguuuugaguauacucgcuu

SEQ ID NO: 28830 - RNA, 21 nt, Artificial Sequence
  Marburg virus siRNA sense strand
uguuuugaguauacucgcuuc

SEQ ID NO: 28831 - RNA, 21 nt, Artificial Sequence
  Marburg virus siRNA sense strand
guuuugaguauacucgcuuca

SEQ ID NO: 28832 - RNA, 21 nt, Artificial Sequence
  Marburg virus siRNA sense strand
uuuugaguauacucgcuucaa

SEQ ID NO: 28833 - RNA, 21 nt, Artificial Sequence
  Marburg virus siRNA sense strand
uuugaguauacucgcuucaau

SEQ ID NO: 28834 - RNA, 21 nt, Artificial Sequence
  Marburg virus siRNA sense strand
uugaguauacucgcuucaaua

SEQ ID NO: 28835 - RNA, 21 nt, Artificial Sequence
  Marburg virus siRNA sense strand
ugaguauacucgcuucaauac

SEQ ID NO: 28836 - RNA, 21 nt, Artificial Sequence
  Marburg virus siRNA sense strand
gaguauacucgcuucaauaca

SEQ ID NO: 28837 - RNA, 21 nt, Artificial Sequence
  Marburg virus siRNA sense strand
aguauacucgcuucaauacaa

SEQ ID NO: 28838 - RNA, 21 nt, Artificial Sequence
  Marburg virus siRNA sense strand
guauacucgcuucaauacaac

SEQ ID NO: 28839 - RNA, 21 nt, Artificial Sequence
  Marburg virus siRNA sense strand
uauacucgcuucaauacaacu

SEQ ID NO: 28840 - RNA, 21 nt, Artificial Sequence
  Marburg virus siRNA sense strand
auacucgcuucaauacaacuu

SEQ ID NO: 28841 - RNA, 21 nt, Artificial Sequence
  Marburg virus siRNA sense strand
uacucgcuucaauacaacuuc

SEQ ID NO: 28842 - RNA, 21 nt, Artificial Sequence
  Marburg virus siRNA sense strand
acucgcuucaauacaacuucc

SEQ ID NO: 28843 - RNA, 21 nt, Artificial Sequence
  Marburg virus siRNA sense strand
cucgcuucaauacaacuuccc

SEQ ID NO: 28844 - RNA, 21 nt, Artificial Sequence
  Marburg virus siRNA sense strand
ucgcuucaauacaacuucccu

SEQ ID NO: 28845 - RNA, 21 nt, Artificial Sequence
  Marburg virus siRNA sense strand
cgcuucaauacaacuucccuu

SEQ ID NO: 28846 - RNA, 21 nt, Artificial Sequence
  Marburg virus siRNA sense strand
gcuucaauacaacuucccuuc

SEQ ID NO: 28847 - RNA, 21 nt, Artificial Sequence
  Marburg virus siRNA sense strand
cuucaauacaacuucccuuca

SEQ ID NO: 28848 - RNA, 21 nt, Artificial Sequence
  Marburg virus siRNA sense strand
uucaauacaacuucccuucau

SEQ ID NO: 28849 - RNA, 21 nt, Artificial Sequence
  Marburg virus siRNA sense strand
ucaauacaacuucccuucaua

SEQ ID NO: 28850 - RNA, 21 nt, Artificial Sequence
  Marburg virus siRNA sense strand
caauacaacuucccuucauau

SEQ ID NO: 28851 - RNA, 21 nt, Artificial Sequence
  Marburg virus siRNA sense strand
aauacaacuucccuucauauu

SEQ ID NO: 28852 - RNA, 21 nt, Artificial Sequence
  Marburg virus siRNA sense strand
auacaacuucccuucauauuu

SEQ ID NO: 28853 - RNA, 21 nt, Artificial Sequence
  Marburg virus siRNA sense strand
uacaacuucccuucauauuug

SEQ ID NO: 28854 - RNA, 21 nt, Artificial Sequence
  Marburg virus siRNA sense strand
acaacuucccuucauauuuga

SEQ ID NO: 28855 - RNA, 21 nt, Artificial Sequence
  Marburg virus siRNA sense strand
caacuucccuucauauuugau

SEQ ID NO: 28856 - RNA, 21 nt, Artificial Sequence
  Marburg virus siRNA sense strand
aacuucccuucauauuugauu

SEQ ID NO: 28857 - RNA, 21 nt, Artificial Sequence
  Marburg virus siRNA sense strand
acuucccuucauauuugauuc

SEQ ID NO: 28858 - RNA, 21 nt, Artificial Sequence
  Marburg virus siRNA sense strand
cuucccuucauauuugauuca

SEQ ID NO: 28859 - RNA, 21 nt, Artificial Sequence
  Marburg virus siRNA sense strand
uucccuucauauuugauucaa

SEQ ID NO: 28860 - RNA, 21 nt, Artificial Sequence
  Marburg virus siRNA sense strand
ucccuucauauuugauucaag

SEQ ID NO: 28861 - RNA, 21 nt, Artificial Sequence
  Marburg virus siRNA sense strand
cccuucauauuugauucaaga

SEQ ID NO: 28862 - RNA, 21 nt, Artificial Sequence
  Marburg virus siRNA sense strand
ccuucauauuugauucaagau

SEQ ID NO: 28863 - RNA, 21 nt, Artificial Sequence
  Marburg virus siRNA sense strand
cuucauauuugauucaagauu

SEQ ID NO: 28864 - RNA, 21 nt, Artificial Sequence
  Marburg virus siRNA sense strand
uucauauuugauucaagauuu

SEQ ID NO: 28865 - RNA, 21 nt, Artificial Sequence
  Marburg virus siRNA sense strand
ucauauuugauucaagauuua

SEQ ID NO: 28866 - RNA, 21 nt, Artificial Sequence
  Marburg virus siRNA sense strand
cauauuugauucaagauuuaa

SEQ ID NO: 28867 - RNA, 21 nt, Artificial Sequence
  Marburg virus siRNA sense strand
auauuugauucaagauuuaaa

SEQ ID NO: 28868 - RNA, 21 nt, Artificial Sequence
  Marburg virus siRNA sense strand
uauuugauucaagauuuaaaa

SEQ ID NO: 28869 - RNA, 21 nt, Artificial Sequence
  Marburg virus siRNA sense strand
auuugauucaagauuuaaaau

SEQ ID NO: 28870 - RNA, 21 nt, Artificial Sequence
  Marburg virus siRNA sense strand
uuugauucaagauuuaaaaug

SEQ ID NO: 28871 - RNA, 21 nt, Artificial Sequence
  Marburg virus siRNA sense strand
uugauucaagauuuaaaaugc

SEQ ID NO: 28872 - RNA, 21 nt, Artificial Sequence
  Marburg virus siRNA sense strand
ugauucaagauuuaaaaugca

SEQ ID NO: 28873 - RNA, 21 nt, Artificial Sequence
  Marburg virus siRNA sense strand
gauucaagauuuaaaaugcaa

SEQ ID NO: 28874 - RNA, 21 nt, Artificial Sequence
  Marburg virus siRNA sense strand
auucaagauuuaaaaugcaac

SEQ ID NO: 28875 - RNA, 21 nt, Artificial Sequence
  Marburg virus siRNA sense strand
uucaagauuuaaaaugcaaca

SEQ ID NO: 28876 - RNA, 21 nt, Artificial Sequence
  Marburg virus siRNA sense strand
ucaagauuuaaaaugcaacaa

SEQ ID NO: 28877 - RNA, 21 nt, Artificial Sequence
  Marburg virus siRNA sense strand
caagauuuaaaaugcaacaac

SEQ ID NO: 28878 - RNA, 21 nt, Artificial Sequence
  Marburg virus siRNA sense strand
aagauuuaaaaugcaacaacc

SEQ ID NO: 28879 - RNA, 21 nt, Artificial Sequence
  Marburg virus siRNA sense strand
agauuuaaaaugcaacaaccc

SEQ ID NO: 28880 - RNA, 21 nt, Artificial Sequence
  Marburg virus siRNA sense strand
gauuuaaaaugcaacaacccc

SEQ ID NO: 28881 - RNA, 21 nt, Artificial Sequence
  Marburg virus siRNA sense strand
auuuaaaaugcaacaaccccg

SEQ ID NO: 28882 - RNA, 21 nt, Artificial Sequence
  Marburg virus siRNA sense strand
uuuaaaaugcaacaaccccgu

SEQ ID NO: 28883 - RNA, 21 nt, Artificial Sequence
  Marburg virus siRNA sense strand
uuaaaaugcaacaaccccgug

SEQ ID NO: 28884 - RNA, 21 nt, Artificial Sequence
  Marburg virus siRNA sense strand
uaaaaugcaacaaccccgugg

SEQ ID NO: 28885 - RNA, 21 nt, Artificial Sequence
  Marburg virus siRNA sense strand
aaaaugcaacaaccccgugga

SEQ ID NO: 28886 - RNA, 21 nt, Artificial Sequence
  Marburg virus siRNA sense strand
aaaugcaacaaccccguggaa

SEQ ID NO: 28887 - RNA, 21 nt, Artificial Sequence
  Marburg virus siRNA sense strand
aaugcaacaaccccguggaag

SEQ ID NO: 28888 - RNA, 21 nt, Artificial Sequence
  Marburg virus siRNA sense strand
augcaacaaccccguggaagg

SEQ ID NO: 28889 - RNA, 21 nt, Artificial Sequence
  Marburg virus siRNA sense strand
ugcaacaaccccguggaagga

SEQ ID NO: 28890 - RNA, 21 nt, Artificial Sequence
  Marburg virus siRNA sense strand
gcaacaaccccguggaaggag

SEQ ID NO: 28891 - RNA, 21 nt, Artificial Sequence
  Marburg virus siRNA sense strand
caacaaccccguggaaggagu

SEQ ID NO: 28892 - RNA, 21 nt, Artificial Sequence
  Marburg virus siRNA sense strand
aacaaccccguggaaggaguc

SEQ ID NO: 28893 - RNA, 21 nt, Artificial Sequence
  Marburg virus siRNA sense strand
acaaccccguggaaggagucg

SEQ ID NO: 28894 - RNA, 21 nt, Artificial Sequence
  Marburg virus siRNA sense strand
caaccccguggaaggagucga

SEQ ID NO: 28895 - RNA, 21 nt, Artificial Sequence
  Marburg virus siRNA sense strand
aaccccguggaaggagucgaa

SEQ ID NO: 28896 - RNA, 21 nt, Artificial Sequence
  Marburg virus siRNA sense strand
accccguggaaggagucgaac

SEQ ID NO: 28897 - RNA, 21 nt, Artificial Sequence
  Marburg virus siRNA sense strand
ccccguggaaggagucgaacu

SEQ ID NO: 28898 - RNA, 21 nt, Artificial Sequence
  Marburg virus siRNA sense strand
cccguggaaggagucgaacuc

SEQ ID NO: 28899 - RNA, 21 nt, Artificial Sequence
  Marburg virus siRNA sense strand
ccguggaaggagucgaacucg

SEQ ID NO: 28900 - RNA, 21 nt, Artificial Sequence
  Marburg virus siRNA sense strand
cguggaaggagucgaacucgc

SEQ ID NO: 28901 - RNA, 21 nt, Artificial Sequence
  Marburg virus siRNA sense strand
guggaaggagucgaacucgca

SEQ ID NO: 28902 - RNA, 21 nt, Artificial Sequence
  Marburg virus siRNA sense strand
uggaaggagucgaacucgcaa

SEQ ID NO: 28903 - RNA, 21 nt, Artificial Sequence
  Marburg virus siRNA sense strand
ggaaggagucgaacucgcaac

SEQ ID NO: 28904 - RNA, 21 nt, Artificial Sequence
  Marburg virus siRNA sense strand
gaaggagucgaacucgcaacc

SEQ ID NO: 28905 - RNA, 21 nt, Artificial Sequence
  Marburg virus siRNA sense strand
aaggagucgaacucgcaacca

SEQ ID NO: 28906 - RNA, 21 nt, Artificial Sequence
  Marburg virus siRNA sense strand
aggagucgaacucgcaaccac

SEQ ID NO: 28907 - RNA, 21 nt, Artificial Sequence
  Marburg virus siRNA sense strand
ggagucgaacucgcaaccacc

SEQ ID NO: 28908 - RNA, 21 nt, Artificial Sequence
  Marburg virus siRNA sense strand
gagucgaacucgcaaccacca

SEQ ID NO: 28909 - RNA, 21 nt, Artificial Sequence
  Marburg virus siRNA sense strand
agucgaacucgcaaccaccaa

SEQ ID NO: 28910 - RNA, 21 nt, Artificial Sequence
  Marburg virus siRNA sense strand
gucgaacucgcaaccaccaaa

SEQ ID NO: 28911 - RNA, 21 nt, Artificial Sequence
  Marburg virus siRNA sense strand
ucgaacucgcaaccaccaaac

SEQ ID NO: 28912 - RNA, 21 nt, Artificial Sequence
  Marburg virus siRNA sense strand
cgaacucgcaaccaccaaacc

SEQ ID NO: 28913 - RNA, 21 nt, Artificial Sequence
  Marburg virus siRNA sense strand
gaacucgcaaccaccaaaccg

SEQ ID NO: 28914 - RNA, 21 nt, Artificial Sequence
  Marburg virus siRNA sense strand
aacucgcaaccaccaaaccgc

SEQ ID NO: 28915 - RNA, 21 nt, Artificial Sequence
  Marburg virus siRNA sense strand
acucgcaaccaccaaaccgca

SEQ ID NO: 28916 - RNA, 21 nt, Artificial Sequence
  Marburg virus siRNA sense strand
cucgcaaccaccaaaccgcau

SEQ ID NO: 28917 - RNA, 21 nt, Artificial Sequence
  Marburg virus siRNA sense strand
ucgcaaccaccaaaccgcauc

SEQ ID NO: 28918 - RNA, 21 nt, Artificial Sequence
  Marburg virus siRNA sense strand
cgcaaccaccaaaccgcauca

SEQ ID NO: 28919 - RNA, 21 nt, Artificial Sequence
  Marburg virus siRNA sense strand
gcaaccaccaaaccgcaucau

SEQ ID NO: 28920 - RNA, 21 nt, Artificial Sequence
  Marburg virus siRNA sense strand
caaccaccaaaccgcaucauc

SEQ ID NO: 28921 - RNA, 21 nt, Artificial Sequence
  Marburg virus siRNA sense strand
aaccaccaaaccgcaucaucu

SEQ ID NO: 28922 - RNA, 21 nt, Artificial Sequence
  Marburg virus siRNA sense strand
accaccaaaccgcaucaucua

SEQ ID NO: 28923 - RNA, 21 nt, Artificial Sequence
  Marburg virus siRNA sense strand
ccaccaaaccgcaucaucuau

SEQ ID NO: 28924 - RNA, 21 nt, Artificial Sequence
  Marburg virus siRNA sense strand
caccaaaccgcaucaucuaua

SEQ ID NO: 28925 - RNA, 21 nt, Artificial Sequence
  Marburg virus siRNA sense strand
accaaaccgcaucaucuauau

SEQ ID NO: 28926 - RNA, 21 nt, Artificial Sequence
  Marburg virus siRNA sense strand
ccaaaccgcaucaucuauaua

SEQ ID NO: 28927 - RNA, 21 nt, Artificial Sequence
  Marburg virus siRNA sense strand
caaaccgcaucaucuauauau

SEQ ID NO: 28928 - RNA, 21 nt, Artificial Sequence
  Marburg virus siRNA sense strand
aaaccgcaucaucuauauauc

SEQ ID NO: 28929 - RNA, 21 nt, Artificial Sequence
  Marburg virus siRNA sense strand
aaccgcaucaucuauauauca

SEQ ID NO: 28930 - RNA, 21 nt, Artificial Sequence
  Marburg virus siRNA sense strand
accgcaucaucuauauaucau

SEQ ID NO: 28931 - RNA, 21 nt, Artificial Sequence
  Marburg virus siRNA sense strand
ccgcaucaucuauauaucaug

SEQ ID NO: 28932 - RNA, 21 nt, Artificial Sequence
  Marburg virus siRNA sense strand
cgcaucaucuauauaucauga

SEQ ID NO: 28933 - RNA, 21 nt, Artificial Sequence
  Marburg virus siRNA sense strand
gcaucaucuauauaucaugaa

SEQ ID NO: 28934 - RNA, 21 nt, Artificial Sequence
  Marburg virus siRNA sense strand
caucaucuauauaucaugaaa

SEQ ID NO: 28935 - RNA, 21 nt, Artificial Sequence
  Marburg virus siRNA sense strand
aucaucuauauaucaugaaac

SEQ ID NO: 28936 - RNA, 21 nt, Artificial Sequence
  Marburg virus siRNA sense strand
ucaucuauauaucaugaaacu

SEQ ID NO: 28937 - RNA, 21 nt, Artificial Sequence
  Marburg virus siRNA sense strand
caucuauauaucaugaaacuc

SEQ ID NO: 28938 - RNA, 21 nt, Artificial Sequence
  Marburg virus siRNA sense strand
aucuauauaucaugaaacuca

SEQ ID NO: 28939 - RNA, 21 nt, Artificial Sequence
  Marburg virus siRNA sense strand
ucuauauaucaugaaacucag

SEQ ID NO: 28940 - RNA, 21 nt, Artificial Sequence
  Marburg virus siRNA sense strand
cuauauaucaugaaacucagu

SEQ ID NO: 28941 - RNA, 21 nt, Artificial Sequence
  Marburg virus siRNA sense strand
uauauaucaugaaacucaguu

SEQ ID NO: 28942 - RNA, 21 nt, Artificial Sequence
  Marburg virus siRNA sense strand
auauaucaugaaacucaguug

SEQ ID NO: 28943 - RNA, 21 nt, Artificial Sequence
  Marburg virus siRNA sense strand
uauaucaugaaacucaguugc

SEQ ID NO: 28944 - RNA, 21 nt, Artificial Sequence
  Marburg virus siRNA sense strand
auaucaugaaacucaguugcc

SEQ ID NO: 28945 - RNA, 21 nt, Artificial Sequence
  Marburg virus siRNA sense strand
uaucaugaaacucaguugccc

SEQ ID NO: 28946 - RNA, 21 nt, Artificial Sequence
  Marburg virus siRNA sense strand
aucaugaaacucaguugcccu

SEQ ID NO: 28947 - RNA, 21 nt, Artificial Sequence
  Marburg virus siRNA sense strand
ucaugaaacucaguugcccuc

SEQ ID NO: 28948 - RNA, 21 nt, Artificial Sequence
  Marburg virus siRNA sense strand
caugaaacucaguugcccucc

SEQ ID NO: 28949 - RNA, 21 nt, Artificial Sequence
  Marburg virus siRNA sense strand
augaaacucaguugcccucca

SEQ ID NO: 28950 - RNA, 21 nt, Artificial Sequence
  Marburg virus siRNA sense strand
ugaaacucaguugcccuccaa

SEQ ID NO: 28951 - RNA, 21 nt, Artificial Sequence
  Marburg virus siRNA sense strand
gaaacucaguugcccuccaaa

SEQ ID NO: 28952 - RNA, 21 nt, Artificial Sequence
  Marburg virus siRNA sense strand
aaacucaguugcccuccaaac

SEQ ID NO: 28953 - RNA, 21 nt, Artificial Sequence
  Marburg virus siRNA sense strand
aacucaguugcccuccaaacc

SEQ ID NO: 28954 - RNA, 21 nt, Artificial Sequence
  Marburg virus siRNA sense strand
acucaguugcccuccaaaccu

SEQ ID NO: 28955 - RNA, 21 nt, Artificial Sequence
  Marburg virus siRNA sense strand
cucaguugcccuccaaaccuc

SEQ ID NO: 28956 - RNA, 21 nt, Artificial Sequence
  Marburg virus siRNA sense strand
ucaguugcccuccaaaccuca

SEQ ID NO: 28957 - RNA, 21 nt, Artificial Sequence
  Marburg virus siRNA sense strand
caguugcccuccaaaccucac

SEQ ID NO: 28958 - RNA, 21 nt, Artificial Sequence
  Marburg virus siRNA sense strand
aguugcccuccaaaccucacu

SEQ ID NO: 28959 - RNA, 21 nt, Artificial Sequence
  Marburg virus siRNA sense strand
guugcccuccaaaccucacua

SEQ ID NO: 28960 - RNA, 21 nt, Artificial Sequence
  Marburg virus siRNA sense strand
uugcccuccaaaccucacuac

SEQ ID NO: 28961 - RNA, 21 nt, Artificial Sequence
  Marburg virus siRNA sense strand
ugcccuccaaaccucacuaca

SEQ ID NO: 28962 - RNA, 21 nt, Artificial Sequence
  Marburg virus siRNA sense strand
gcccuccaaaccucacuacac

SEQ ID NO: 28963 - RNA, 21 nt, Artificial Sequence
  Marburg virus siRNA sense strand
cccuccaaaccucacuacacc

SEQ ID NO: 28964 - RNA, 21 nt, Artificial Sequence
  Marburg virus siRNA sense strand
ccuccaaaccucacuacacca

SEQ ID NO: 28965 - RNA, 21 nt, Artificial Sequence
  Marburg virus siRNA sense strand
cuccaaaccucacuacaccaa

SEQ ID NO: 28966 - RNA, 21 nt, Artificial Sequence
  Marburg virus siRNA sense strand
uccaaaccucacuacaccaau

SEQ ID NO: 28967 - RNA, 21 nt, Artificial Sequence
  Marburg virus siRNA sense strand
ccaaaccucacuacaccaauc

SEQ ID NO: 28968 - RNA, 21 nt, Artificial Sequence
  Marburg virus siRNA sense strand
caaaccucacuacaccaauca

SEQ ID NO: 28969 - RNA, 21 nt, Artificial Sequence
  Marburg virus siRNA sense strand
aaaccucacuacaccaaucau

SEQ ID NO: 28970 - RNA, 21 nt, Artificial Sequence
  Marburg virus siRNA sense strand
aaccucacuacaccaaucauc

SEQ ID NO: 28971 - RNA, 21 nt, Artificial Sequence
  Marburg virus siRNA sense strand
accucacuacaccaaucauca

SEQ ID NO: 28972 - RNA, 21 nt, Artificial Sequence
  Marburg virus siRNA sense strand
ccucacuacaccaaucaucau

SEQ ID NO: 28973 - RNA, 21 nt, Artificial Sequence
  Marburg virus siRNA sense strand
cucacuacaccaaucaucauc

SEQ ID NO: 28974 - RNA, 21 nt, Artificial Sequence
  Marburg virus siRNA sense strand
ucacuacaccaaucaucaucc

SEQ ID NO: 28975 - RNA, 21 nt, Artificial Sequence
  Marburg virus siRNA sense strand
cacuacaccaaucaucaucca

SEQ ID NO: 28976 - RNA, 21 nt, Artificial Sequence
  Marburg virus siRNA sense strand
acuacaccaaucaucauccac

SEQ ID NO: 28977 - RNA, 21 nt, Artificial Sequence
  Marburg virus siRNA sense strand
cuacaccaaucaucauccacg

SEQ ID NO: 28978 - RNA, 21 nt, Artificial Sequence
  Marburg virus siRNA sense strand
uacaccaaucaucauccacgu

SEQ ID NO: 28979 - RNA, 21 nt, Artificial Sequence
  Marburg virus siRNA sense strand
acaccaaucaucauccacgug

SEQ ID NO: 28980 - RNA, 21 nt, Artificial Sequence
  Marburg virus siRNA sense strand
caccaaucaucauccacgugc

SEQ ID NO: 28981 - RNA, 21 nt, Artificial Sequence
  Marburg virus siRNA sense strand
accaaucaucauccacgugca

SEQ ID NO: 28982 - RNA, 21 nt, Artificial Sequence
  Marburg virus siRNA sense strand
ccaaucaucauccacgugcaa

SEQ ID NO: 28983 - RNA, 21 nt, Artificial Sequence
  Marburg virus siRNA sense strand
caaucaucauccacgugcaag

SEQ ID NO: 28984 - RNA, 21 nt, Artificial Sequence
  Marburg virus siRNA sense strand
aaucaucauccacgugcaaga

SEQ ID NO: 28985 - RNA, 21 nt, Artificial Sequence
  Marburg virus siRNA sense strand
aucaucauccacgugcaagau

SEQ ID NO: 28986 - RNA, 21 nt, Artificial Sequence
  Marburg virus siRNA sense strand
ucaucauccacgugcaagauc

SEQ ID NO: 28987 - RNA, 21 nt, Artificial Sequence
  Marburg virus siRNA sense strand
caucauccacgugcaagaucg

SEQ ID NO: 28988 - RNA, 21 nt, Artificial Sequence
  Marburg virus siRNA sense strand
aucauccacgugcaagaucga

SEQ ID NO: 28989 - RNA, 21 nt, Artificial Sequence
  Marburg virus siRNA sense strand
ucauccacgugcaagaucgau

SEQ ID NO: 28990 - RNA, 21 nt, Artificial Sequence
  Marburg virus siRNA sense strand
cauccacgugcaagaucgaug

SEQ ID NO: 28991 - RNA, 21 nt, Artificial Sequence
  Marburg virus siRNA sense strand
auccacgugcaagaucgauga

SEQ ID NO: 28992 - RNA, 21 nt, Artificial Sequence
  Marburg virus siRNA sense strand
uccacgugcaagaucgaugag

SEQ ID NO: 28993 - RNA, 21 nt, Artificial Sequence
  Marburg virus siRNA sense strand
ccacgugcaagaucgaugagc

SEQ ID NO: 28994 - RNA, 21 nt, Artificial Sequence
  Marburg virus siRNA sense strand
cacgugcaagaucgaugagcu

SEQ ID NO: 28995 - RNA, 21 nt, Artificial Sequence
  Marburg virus siRNA sense strand
acgugcaagaucgaugagcuc

SEQ ID NO: 28996 - RNA, 21 nt, Artificial Sequence
  Marburg virus siRNA sense strand
cgugcaagaucgaugagcuca

SEQ ID NO: 28997 - RNA, 21 nt, Artificial Sequence
  Marburg virus siRNA sense strand
gugcaagaucgaugagcucaa

SEQ ID NO: 28998 - RNA, 21 nt, Artificial Sequence
  Marburg virus siRNA sense strand
ugcaagaucgaugagcucaac

SEQ ID NO: 28999 - RNA, 21 nt, Artificial Sequence
  Marburg virus siRNA sense strand
gcaagaucgaugagcucaacc

SEQ ID NO: 29000 - RNA, 21 nt, Artificial Sequence
  Marburg virus siRNA sense strand
caagaucgaugagcucaaccc

SEQ ID NO: 29001 - RNA, 21 nt, Artificial Sequence
  Marburg virus siRNA sense strand
aagaucgaugagcucaacccg

SEQ ID NO: 29002 - RNA, 21 nt, Artificial Sequence
  Marburg virus siRNA sense strand
agaucgaugagcucaacccgc

SEQ ID NO: 29003 - RNA, 21 nt, Artificial Sequence
  Marburg virus siRNA sense strand
gaucgaugagcucaacccgca

SEQ ID NO: 29004 - RNA, 21 nt, Artificial Sequence
  Marburg virus siRNA sense strand
aucgaugagcucaacccgcag

SEQ ID NO: 29005 - RNA, 21 nt, Artificial Sequence
  Marburg virus siRNA sense strand
ucgaugagcucaacccgcagu

SEQ ID NO: 29006 - RNA, 21 nt, Artificial Sequence
  Marburg virus siRNA sense strand
cgaugagcucaacccgcagua

SEQ ID NO: 29007 - RNA, 21 nt, Artificial Sequence
  Marburg virus siRNA sense strand
gaugagcucaacccgcaguag

SEQ ID NO: 29008 - RNA, 21 nt, Artificial Sequence
  Marburg virus siRNA sense strand
augagcucaacccgcaguagu

SEQ ID NO: 29009 - RNA, 21 nt, Artificial Sequence
  Marburg virus siRNA sense strand
ugagcucaacccgcaguagug

SEQ ID NO: 29010 - RNA, 21 nt, Artificial Sequence
  Marburg virus siRNA sense strand
gagcucaacccgcaguagugc

SEQ ID NO: 29011 - RNA, 21 nt, Artificial Sequence
  Marburg virus siRNA sense strand
agcucaacccgcaguagugca

SEQ ID NO: 29012 - RNA, 21 nt, Artificial Sequence
  Marburg virus siRNA sense strand
gcucaacccgcaguagugcag

SEQ ID NO: 29013 - RNA, 21 nt, Artificial Sequence
  Marburg virus siRNA sense strand
cucaacccgcaguagugcaga

SEQ ID NO: 29014 - RNA, 21 nt, Artificial Sequence
  Marburg virus siRNA sense strand
ucaacccgcaguagugcagaa

SEQ ID NO: 29015 - RNA, 21 nt, Artificial Sequence
  Marburg virus siRNA sense strand
caacccgcaguagugcagaaa

SEQ ID NO: 29016 - RNA, 21 nt, Artificial Sequence
  Marburg virus siRNA sense strand
aacccgcaguagugcagaaag

SEQ ID NO: 29017 - RNA, 21 nt, Artificial Sequence
  Marburg virus siRNA sense strand
acccgcaguagugcagaaagc

SEQ ID NO: 29018 - RNA, 21 nt, Artificial Sequence
  Marburg virus siRNA sense strand
cccgcaguagugcagaaagca

SEQ ID NO: 29019 - RNA, 21 nt, Artificial Sequence
  Marburg virus siRNA sense strand
ccgcaguagugcagaaagcag

SEQ ID NO: 29020 - RNA, 21 nt, Artificial Sequence
  Marburg virus siRNA sense strand
cgcaguagugcagaaagcagu

SEQ ID NO: 29021 - RNA, 21 nt, Artificial Sequence
  Marburg virus siRNA sense strand
gcaguagugcagaaagcaguc

SEQ ID NO: 29022 - RNA, 21 nt, Artificial Sequence
  Marburg virus siRNA sense strand
caguagugcagaaagcagucc

SEQ ID NO: 29023 - RNA, 21 nt, Artificial Sequence
  Marburg virus siRNA sense strand
aguagugcagaaagcaguccc

SEQ ID NO: 29024 - RNA, 21 nt, Artificial Sequence
  Marburg virus siRNA sense strand
guagugcagaaagcaguccca

SEQ ID NO: 29025 - RNA, 21 nt, Artificial Sequence
  Marburg virus siRNA sense strand
uagugcagaaagcagucccac

SEQ ID NO: 29026 - RNA, 21 nt, Artificial Sequence
  Marburg virus siRNA sense strand
agugcagaaagcagucccacc

SEQ ID NO: 29027 - RNA, 21 nt, Artificial Sequence
  Marburg virus siRNA sense strand
gugcagaaagcagucccacca

SEQ ID NO: 29028 - RNA, 21 nt, Artificial Sequence
  Marburg virus siRNA sense strand
ugcagaaagcagucccaccaa

SEQ ID NO: 29029 - RNA, 21 nt, Artificial Sequence
  Marburg virus siRNA sense strand
gcagaaagcagucccaccaau

SEQ ID NO: 29030 - RNA, 21 nt, Artificial Sequence
  Marburg virus siRNA sense strand
cagaaagcagucccaccaauc

SEQ ID NO: 29031 - RNA, 21 nt, Artificial Sequence
  Marburg virus siRNA sense strand
agaaagcagucccaccaauca

SEQ ID NO: 29032 - RNA, 21 nt, Artificial Sequence
  Marburg virus siRNA sense strand
gaaagcagucccaccaaucau

SEQ ID NO: 29033 - RNA, 21 nt, Artificial Sequence
  Marburg virus siRNA sense strand
aaagcagucccaccaaucaua

SEQ ID NO: 29034 - RNA, 21 nt, Artificial Sequence
  Marburg virus siRNA sense strand
aagcagucccaccaaucauau

SEQ ID NO: 29035 - RNA, 21 nt, Artificial Sequence
  Marburg virus siRNA sense strand
agcagucccaccaaucauauu

SEQ ID NO: 29036 - RNA, 21 nt, Artificial Sequence
  Marburg virus siRNA sense strand
gcagucccaccaaucauauuc

SEQ ID NO: 29037 - RNA, 21 nt, Artificial Sequence
  Marburg virus siRNA sense strand
cagucccaccaaucauauucc

SEQ ID NO: 29038 - RNA, 21 nt, Artificial Sequence
  Marburg virus siRNA sense strand
agucccaccaaucauauuccc

SEQ ID NO: 29039 - RNA, 21 nt, Artificial Sequence
  Marburg virus siRNA sense strand
gucccaccaaucauauucccc

SEQ ID NO: 29040 - RNA, 21 nt, Artificial Sequence
  Marburg virus siRNA sense strand
ucccaccaaucauauuccccg

SEQ ID NO: 29041 - RNA, 21 nt, Artificial Sequence
  Marburg virus siRNA sense strand
cccaccaaucauauuccccgu

SEQ ID NO: 29042 - RNA, 21 nt, Artificial Sequence
  Marburg virus siRNA sense strand
ccaccaaucauauuccccgug

SEQ ID NO: 29043 - RNA, 21 nt, Artificial Sequence
  Marburg virus siRNA sense strand
caccaaucauauuccccgugc

SEQ ID NO: 29044 - RNA, 21 nt, Artificial Sequence
  Marburg virus siRNA sense strand
accaaucauauuccccgugcu

SEQ ID NO: 29045 - RNA, 21 nt, Artificial Sequence
  Marburg virus siRNA sense strand
ccaaucauauuccccgugcuc

SEQ ID NO: 29046 - RNA, 21 nt, Artificial Sequence
  Marburg virus siRNA sense strand
caaucauauuccccgugcucg

SEQ ID NO: 29047 - RNA, 21 nt, Artificial Sequence
  Marburg virus siRNA sense strand
aaucauauuccccgugcucga

SEQ ID NO: 29048 - RNA, 21 nt, Artificial Sequence
  Marburg virus siRNA sense strand
aucauauuccccgugcucgac

SEQ ID NO: 29049 - RNA, 21 nt, Artificial Sequence
  Marburg virus siRNA sense strand
ucauauuccccgugcucgacc

SEQ ID NO: 29050 - RNA, 21 nt, Artificial Sequence
  Marburg virus siRNA sense strand
cauauuccccgugcucgacca

SEQ ID NO: 29051 - RNA, 21 nt, Artificial Sequence
  Marburg virus siRNA sense strand
auauuccccgugcucgaccac

SEQ ID NO: 29052 - RNA, 21 nt, Artificial Sequence
  Marburg virus siRNA sense strand
uauuccccgugcucgaccacc

SEQ ID NO: 29053 - RNA, 21 nt, Artificial Sequence
  Marburg virus siRNA sense strand
auuccccgugcucgaccaccc

SEQ ID NO: 29054 - RNA, 21 nt, Artificial Sequence
  Marburg virus siRNA sense strand
uuccccgugcucgaccacccc

SEQ ID NO: 29055 - RNA, 21 nt, Artificial Sequence
  Marburg virus siRNA sense strand
uccccgugcucgaccaccccc

SEQ ID NO: 29056 - RNA, 21 nt, Artificial Sequence
  Marburg virus siRNA sense strand
ccccgugcucgaccaccccca

SEQ ID NO: 29057 - RNA, 21 nt, Artificial Sequence
  Marburg virus siRNA sense strand
cccgugcucgaccacccccaa

SEQ ID NO: 29058 - RNA, 21 nt, Artificial Sequence
  Marburg virus siRNA sense strand
ccgugcucgaccacccccaac

SEQ ID NO: 29059 - RNA, 21 nt, Artificial Sequence
  Marburg virus siRNA sense strand
cgugcucgaccacccccaaca

SEQ ID NO: 29060 - RNA, 21 nt, Artificial Sequence
  Marburg virus siRNA sense strand
gugcucgaccacccccaacau

SEQ ID NO: 29061 - RNA, 21 nt, Artificial Sequence
  Marburg virus siRNA sense strand
ugcucgaccacccccaacauu

SEQ ID NO: 29062 - RNA, 21 nt, Artificial Sequence
  Marburg virus siRNA sense strand
gcucgaccacccccaacauuc

SEQ ID NO: 29063 - RNA, 21 nt, Artificial Sequence
  Marburg virus siRNA sense strand
cucgaccacccccaacauuca

SEQ ID NO: 29064 - RNA, 21 nt, Artificial Sequence
  Marburg virus siRNA sense strand
ucgaccacccccaacauucaa

SEQ ID NO: 29065 - RNA, 21 nt, Artificial Sequence
  Marburg virus siRNA sense strand
cgaccacccccaacauucaac

SEQ ID NO: 29066 - RNA, 21 nt, Artificial Sequence
  Marburg virus siRNA sense strand
gaccacccccaacauucaacu

SEQ ID NO: 29067 - RNA, 21 nt, Artificial Sequence
  Marburg virus siRNA sense strand
accacccccaacauucaacuu

SEQ ID NO: 29068 - RNA, 21 nt, Artificial Sequence
  Marburg virus siRNA sense strand
ccacccccaacauucaacuua

SEQ ID NO: 29069 - RNA, 21 nt, Artificial Sequence
  Marburg virus siRNA sense strand
cacccccaacauucaacuuau

SEQ ID NO: 29070 - RNA, 21 nt, Artificial Sequence
  Marburg virus siRNA sense strand
acccccaacauucaacuuauc

SEQ ID NO: 29071 - RNA, 21 nt, Artificial Sequence
  Marburg virus siRNA sense strand
cccccaacauucaacuuaucg

SEQ ID NO: 29072 - RNA, 21 nt, Artificial Sequence
  Marburg virus siRNA sense strand
ccccaacauucaacuuaucga

SEQ ID NO: 29073 - RNA, 21 nt, Artificial Sequence
  Marburg virus siRNA sense strand
cccaacauucaacuuaucgaa

SEQ ID NO: 29074 - RNA, 21 nt, Artificial Sequence
  Marburg virus siRNA sense strand
ccaacauucaacuuaucgaaa

SEQ ID NO: 29075 - RNA, 21 nt, Artificial Sequence
  Marburg virus siRNA sense strand
caacauucaacuuaucgaaac

SEQ ID NO: 29076 - RNA, 21 nt, Artificial Sequence
  Marburg virus siRNA sense strand
aacauucaacuuaucgaaacc

SEQ ID NO: 29077 - RNA, 21 nt, Artificial Sequence
  Marburg virus siRNA sense strand
acauucaacuuaucgaaaccc

SEQ ID NO: 29078 - RNA, 21 nt, Artificial Sequence
  Marburg virus siRNA sense strand
cauucaacuuaucgaaacccc

SEQ ID NO: 29079 - RNA, 21 nt, Artificial Sequence
  Marburg virus siRNA sense strand
auucaacuuaucgaaaccccc

SEQ ID NO: 29080 - RNA, 21 nt, Artificial Sequence
  Marburg virus siRNA sense strand
uucaacuuaucgaaacccccu

SEQ ID NO: 29081 - RNA, 21 nt, Artificial Sequence
  Marburg virus siRNA sense strand
ucaacuuaucgaaacccccuc

SEQ ID NO: 29082 - RNA, 21 nt, Artificial Sequence
  Marburg virus siRNA sense strand
caacuuaucgaaacccccucc

SEQ ID NO: 29083 - RNA, 21 nt, Artificial Sequence
  Marburg virus siRNA sense strand
aacuuaucgaaacccccuccu

SEQ ID NO: 29084 - RNA, 21 nt, Artificial Sequence
  Marburg virus siRNA sense strand
acuuaucgaaacccccuccuc

SEQ ID NO: 29085 - RNA, 21 nt, Artificial Sequence
  Marburg virus siRNA sense strand
cuuaucgaaacccccuccucc

SEQ ID NO: 29086 - RNA, 21 nt, Artificial Sequence
  Marburg virus siRNA sense strand
uuaucgaaacccccuccuccu

SEQ ID NO: 29087 - RNA, 21 nt, Artificial Sequence
  Marburg virus siRNA sense strand
uaucgaaacccccuccuccuc

SEQ ID NO: 29088 - RNA, 21 nt, Artificial Sequence
  Marburg virus siRNA sense strand
aucgaaacccccuccuccucc

SEQ ID NO: 29089 - RNA, 21 nt, Artificial Sequence
  Marburg virus siRNA sense strand
ucgaaacccccuccuccucca

SEQ ID NO: 29090 - RNA, 21 nt, Artificial Sequence
  Marburg virus siRNA sense strand
cgaaacccccuccuccuccaa

SEQ ID NO: 29091 - RNA, 21 nt, Artificial Sequence
  Marburg virus siRNA sense strand
gaaacccccuccuccuccaaa

SEQ ID NO: 29092 - RNA, 21 nt, Artificial Sequence
  Marburg virus siRNA sense strand
aaacccccuccuccuccaaaa

SEQ ID NO: 29093 - RNA, 21 nt, Artificial Sequence
  Marburg virus siRNA sense strand
aacccccuccuccuccaaaag

SEQ ID NO: 29094 - RNA, 21 nt, Artificial Sequence
  Marburg virus siRNA sense strand
acccccuccuccuccaaaaga

SEQ ID NO: 29095 - RNA, 21 nt, Artificial Sequence
  Marburg virus siRNA sense strand
cccccuccuccuccaaaagac

SEQ ID NO: 29096 - RNA, 21 nt, Artificial Sequence
  Marburg virus siRNA sense strand
ccccuccuccuccaaaagaca

SEQ ID NO: 29097 - RNA, 21 nt, Artificial Sequence
  Marburg virus siRNA sense strand
cccuccuccuccaaaagacau

SEQ ID NO: 29098 - RNA, 21 nt, Artificial Sequence
  Marburg virus siRNA sense strand
ccuccuccuccaaaagacaug

SEQ ID NO: 29099 - RNA, 21 nt, Artificial Sequence
  Marburg virus siRNA sense strand
cuccuccuccaaaagacaugu

SEQ ID NO: 29100 - RNA, 21 nt, Artificial Sequence
  Marburg virus siRNA sense strand
uccuccuccaaaagacaugug

SEQ ID NO: 29101 - RNA, 21 nt, Artificial Sequence
  Marburg virus siRNA sense strand
ccuccuccaaaagacaugugu

SEQ ID NO: 29102 - RNA, 21 nt, Artificial Sequence
  Marburg virus siRNA sense strand
cuccuccaaaagacaugugua

SEQ ID NO: 29103 - RNA, 21 nt, Artificial Sequence
  Marburg virus siRNA sense strand
uccuccaaaagacauguguag

SEQ ID NO: 29104 - RNA, 21 nt, Artificial Sequence
  Marburg virus siRNA sense strand
ccuccaaaagacauguguagg

SEQ ID NO: 29105 - RNA, 21 nt, Artificial Sequence
  Marburg virus siRNA sense strand
cuccaaaagacauguguagga

SEQ ID NO: 29106 - RNA, 21 nt, Artificial Sequence
  Marburg virus siRNA sense strand
uccaaaagacauguguaggaa

SEQ ID NO: 29107 - RNA, 21 nt, Artificial Sequence
  Marburg virus siRNA sense strand
ccaaaagacauguguaggaac

SEQ ID NO: 29108 - RNA, 21 nt, Artificial Sequence
  Marburg virus siRNA sense strand
caaaagacauguguaggaaca

SEQ ID NO: 29109 - RNA, 21 nt, Artificial Sequence
  Marburg virus siRNA sense strand
aaaagacauguguaggaacau

SEQ ID NO: 29110 - RNA, 21 nt, Artificial Sequence
  Marburg virus siRNA sense strand
aaagacauguguaggaacaug

SEQ ID NO: 29111 - RNA, 21 nt, Artificial Sequence
  Marburg virus siRNA sense strand
aagacauguguaggaacauga

SEQ ID NO: 29112 - RNA, 21 nt, Artificial Sequence
  Marburg virus siRNA sense strand
agacauguguaggaacaugaa

SEQ ID NO: 29113 - RNA, 21 nt, Artificial Sequence
  Marburg virus siRNA sense strand
gacauguguaggaacaugaaa

SEQ ID NO: 29114 - RNA, 21 nt, Artificial Sequence
  Marburg virus siRNA sense strand
acauguguaggaacaugaaaa

SEQ ID NO: 29115 - RNA, 21 nt, Artificial Sequence
  Marburg virus siRNA sense strand
cauguguaggaacaugaaaau

SEQ ID NO: 29116 - RNA, 21 nt, Artificial Sequence
  Marburg virus siRNA sense strand
auguguaggaacaugaaaauu

SEQ ID NO: 29117 - RNA, 21 nt, Artificial Sequence
  Marburg virus siRNA sense strand
uguguaggaacaugaaaauug

SEQ ID NO: 29118 - RNA, 21 nt, Artificial Sequence
  Marburg virus siRNA sense strand
guguaggaacaugaaaauugg

SEQ ID NO: 29119 - RNA, 21 nt, Artificial Sequence
  Marburg virus siRNA sense strand
uguaggaacaugaaaauugga

SEQ ID NO: 29120 - RNA, 21 nt, Artificial Sequence
  Marburg virus siRNA sense strand
guaggaacaugaaaauuggau

SEQ ID NO: 29121 - RNA, 21 nt, Artificial Sequence
  Marburg virus siRNA sense strand
uaggaacaugaaaauuggauu

SEQ ID NO: 29122 - RNA, 21 nt, Artificial Sequence
  Marburg virus siRNA sense strand
aggaacaugaaaauuggauug

SEQ ID NO: 29123 - RNA, 21 nt, Artificial Sequence
  Marburg virus siRNA sense strand
ggaacaugaaaauuggauugc

SEQ ID NO: 29124 - RNA, 21 nt, Artificial Sequence
  Marburg virus siRNA sense strand
gaacaugaaaauuggauugcc

SEQ ID NO: 29125 - RNA, 21 nt, Artificial Sequence
  Marburg virus siRNA sense strand
aacaugaaaauuggauugccg

SEQ ID NO: 29126 - RNA, 21 nt, Artificial Sequence
  Marburg virus siRNA sense strand
acaugaaaauuggauugccgu

SEQ ID NO: 29127 - RNA, 21 nt, Artificial Sequence
  Marburg virus siRNA sense strand
caugaaaauuggauugccgug

SEQ ID NO: 29128 - RNA, 21 nt, Artificial Sequence
  Marburg virus siRNA sense strand
augaaaauuggauugccgugc

SEQ ID NO: 29129 - RNA, 21 nt, Artificial Sequence
  Marburg virus siRNA sense strand
ugaaaauuggauugccgugca

SEQ ID NO: 29130 - RNA, 21 nt, Artificial Sequence
  Marburg virus siRNA sense strand
gaaaauuggauugccgugcac

SEQ ID NO: 29131 - RNA, 21 nt, Artificial Sequence
  Marburg virus siRNA sense strand
aaaauuggauugccgugcacu

SEQ ID NO: 29132 - RNA, 21 nt, Artificial Sequence
  Marburg virus siRNA sense strand
aaauuggauugccgugcacug

SEQ ID NO: 29133 - RNA, 21 nt, Artificial Sequence
  Marburg virus siRNA sense strand
aauuggauugccgugcacuga

SEQ ID NO: 29134 - RNA, 21 nt, Artificial Sequence
  Marburg virus siRNA sense strand
auuggauugccgugcacugau

SEQ ID NO: 29135 - RNA, 21 nt, Artificial Sequence
  Marburg virus siRNA sense strand
uuggauugccgugcacugauc

SEQ ID NO: 29136 - RNA, 21 nt, Artificial Sequence
  Marburg virus siRNA sense strand
uggauugccgugcacugaucc

SEQ ID NO: 29137 - RNA, 21 nt, Artificial Sequence
  Marburg virus siRNA sense strand
ggauugccgugcacugauccc

SEQ ID NO: 29138 - RNA, 21 nt, Artificial Sequence
  Marburg virus siRNA sense strand
gauugccgugcacugauccca

SEQ ID NO: 29139 - RNA, 21 nt, Artificial Sequence
  Marburg virus siRNA sense strand
auugccgugcacugaucccac

SEQ ID NO: 29140 - RNA, 21 nt, Artificial Sequence
  Marburg virus siRNA sense strand
uugccgugcacugaucccacu

SEQ ID NO: 29141 - RNA, 21 nt, Artificial Sequence
  Marburg virus siRNA sense strand
ugccgugcacugaucccacuu

SEQ ID NO: 29142 - RNA, 21 nt, Artificial Sequence
  Marburg virus siRNA sense strand
gccgugcacugaucccacuug

SEQ ID NO: 29143 - RNA, 21 nt, Artificial Sequence
  Marburg virus siRNA sense strand
ccgugcacugaucccacuugu

SEQ ID NO: 29144 - RNA, 21 nt, Artificial Sequence
  Marburg virus siRNA sense strand
cgugcacugaucccacuugua

SEQ ID NO: 29145 - RNA, 21 nt, Artificial Sequence
  Marburg virus siRNA sense strand
gugcacugaucccacuuguaa

SEQ ID NO: 29146 - RNA, 21 nt, Artificial Sequence
  Marburg virus siRNA sense strand
ugcacugaucccacuuguaau

SEQ ID NO: 29147 - RNA, 21 nt, Artificial Sequence
  Marburg virus siRNA sense strand
gcacugaucccacuuguaaua

SEQ ID NO: 29148 - RNA, 21 nt, Artificial Sequence
  Marburg virus siRNA sense strand
cacugaucccacuuguaauag

SEQ ID NO: 29149 - RNA, 21 nt, Artificial Sequence
  Marburg virus siRNA sense strand
acugaucccacuuguaauaga

SEQ ID NO: 29150 - RNA, 21 nt, Artificial Sequence
  Marburg virus siRNA sense strand
cugaucccacuuguaauagag

SEQ ID NO: 29151 - RNA, 21 nt, Artificial Sequence
  Marburg virus siRNA sense strand
ugaucccacuuguaauagaga

SEQ ID NO: 29152 - RNA, 21 nt, Artificial Sequence
  Marburg virus siRNA sense strand
gaucccacuuguaauagagau

SEQ ID NO: 29153 - RNA, 21 nt, Artificial Sequence
  Marburg virus siRNA sense strand
aucccacuuguaauagagauc

SEQ ID NO: 29154 - RNA, 21 nt, Artificial Sequence
  Marburg virus siRNA sense strand
ucccacuuguaauagagauca

SEQ ID NO: 29155 - RNA, 21 nt, Artificial Sequence
  Marburg virus siRNA sense strand
cccacuuguaauagagaucau

SEQ ID NO: 29156 - RNA, 21 nt, Artificial Sequence
  Marburg virus siRNA sense strand
ccacuuguaauagagaucaug

SEQ ID NO: 29157 - RNA, 21 nt, Artificial Sequence
  Marburg virus siRNA sense strand
cacuuguaauagagaucauga

SEQ ID NO: 29158 - RNA, 21 nt, Artificial Sequence
  Marburg virus siRNA sense strand
acuuguaauagagaucaugac

SEQ ID NO: 29159 - RNA, 21 nt, Artificial Sequence
  Marburg virus siRNA sense strand
cuuguaauagagaucaugacc

SEQ ID NO: 29160 - RNA, 21 nt, Artificial Sequence
  Marburg virus siRNA sense strand
uuguaauagagaucaugaccu

SEQ ID NO: 29161 - RNA, 21 nt, Artificial Sequence
  Marburg virus siRNA sense strand
uguaauagagaucaugaccuu

SEQ ID NO: 29162 - RNA, 21 nt, Artificial Sequence
  Marburg virus siRNA sense strand
guaauagagaucaugaccuug

SEQ ID NO: 29163 - RNA, 21 nt, Artificial Sequence
  Marburg virus siRNA sense strand
uaauagagaucaugaccuuga

SEQ ID NO: 29164 - RNA, 21 nt, Artificial Sequence
  Marburg virus siRNA sense strand
aauagagaucaugaccuugau

SEQ ID NO: 29165 - RNA, 21 nt, Artificial Sequence
  Marburg virus siRNA sense strand
auagagaucaugaccuugaua

SEQ ID NO: 29166 - RNA, 21 nt, Artificial Sequence
  Marburg virus siRNA sense strand
uagagaucaugaccuugauaa

SEQ ID NO: 29167 - RNA, 21 nt, Artificial Sequence
  Marburg virus siRNA sense strand
agagaucaugaccuugauaau

SEQ ID NO: 29168 - RNA, 21 nt, Artificial Sequence
  Marburg virus siRNA sense strand
gagaucaugaccuugauaauc

SEQ ID NO: 29169 - RNA, 21 nt, Artificial Sequence
  Marburg virus siRNA sense strand
agaucaugaccuugauaaucu

SEQ ID NO: 29170 - RNA, 21 nt, Artificial Sequence
  Marburg virus siRNA sense strand
gaucaugaccuugauaaucua

SEQ ID NO: 29171 - RNA, 21 nt, Artificial Sequence
  Marburg virus siRNA sense strand
aucaugaccuugauaaucuaa

SEQ ID NO: 29172 - RNA, 21 nt, Artificial Sequence
  Marburg virus siRNA sense strand
ucaugaccuugauaaucuaac

SEQ ID NO: 29173 - RNA, 21 nt, Artificial Sequence
  Marburg virus siRNA sense strand
caugaccuugauaaucuaaca

SEQ ID NO: 29174 - RNA, 21 nt, Artificial Sequence
  Marburg virus siRNA sense strand
augaccuugauaaucuaacaa

SEQ ID NO: 29175 - RNA, 21 nt, Artificial Sequence
  Marburg virus siRNA sense strand
ugaccuugauaaucuaacaaa

SEQ ID NO: 29176 - RNA, 21 nt, Artificial Sequence
  Marburg virus siRNA sense strand
gaccuugauaaucuaacaaau

SEQ ID NO: 29177 - RNA, 21 nt, Artificial Sequence
  Marburg virus siRNA sense strand
accuugauaaucuaacaaauc

SEQ ID NO: 29178 - RNA, 21 nt, Artificial Sequence
  Marburg virus siRNA sense strand
ccuugauaaucuaacaaaucg

SEQ ID NO: 29179 - RNA, 21 nt, Artificial Sequence
  Marburg virus siRNA sense strand
cuugauaaucuaacaaaucgu

SEQ ID NO: 29180 - RNA, 21 nt, Artificial Sequence
  Marburg virus siRNA sense strand
uugauaaucuaacaaaucgug

SEQ ID NO: 29181 - RNA, 21 nt, Artificial Sequence
  Marburg virus siRNA sense strand
ugauaaucuaacaaaucguga

SEQ ID NO: 29182 - RNA, 21 nt, Artificial Sequence
  Marburg virus siRNA sense strand
gauaaucuaacaaaucgugaa

SEQ ID NO: 29183 - RNA, 21 nt, Artificial Sequence
  Marburg virus siRNA sense strand
auaaucuaacaaaucgugaac

SEQ ID NO: 29184 - RNA, 21 nt, Artificial Sequence
  Marburg virus siRNA sense strand
uaaucuaacaaaucgugaacu

SEQ ID NO: 29185 - RNA, 21 nt, Artificial Sequence
  Marburg virus siRNA sense strand
aaucuaacaaaucgugaacuu

SEQ ID NO: 29186 - RNA, 21 nt, Artificial Sequence
  Marburg virus siRNA sense strand
aucuaacaaaucgugaacuuu

SEQ ID NO: 29187 - RNA, 21 nt, Artificial Sequence
  Marburg virus siRNA sense strand
ucuaacaaaucgugaacuuuu

SEQ ID NO: 29188 - RNA, 21 nt, Artificial Sequence
  Marburg virus siRNA sense strand
cuaacaaaucgugaacuuuug

SEQ ID NO: 29189 - RNA, 21 nt, Artificial Sequence
  Marburg virus siRNA sense strand
uaacaaaucgugaacuuuugc

SEQ ID NO: 29190 - RNA, 21 nt, Artificial Sequence
  Marburg virus siRNA sense strand
aacaaaucgugaacuuuugcu

SEQ ID NO: 29191 - RNA, 21 nt, Artificial Sequence
  Marburg virus siRNA sense strand
acaaaucgugaacuuuugcua

SEQ ID NO: 29192 - RNA, 21 nt, Artificial Sequence
  Marburg virus siRNA sense strand
caaaucgugaacuuuugcuau

SEQ ID NO: 29193 - RNA, 21 nt, Artificial Sequence
  Marburg virus siRNA sense strand
aaaucgugaacuuuugcuauu

SEQ ID NO: 29194 - RNA, 21 nt, Artificial Sequence
  Marburg virus siRNA sense strand
aaucgugaacuuuugcuauug

SEQ ID NO: 29195 - RNA, 21 nt, Artificial Sequence
  Marburg virus siRNA sense strand
aucgugaacuuuugcuauuga

SEQ ID NO: 29196 - RNA, 21 nt, Artificial Sequence
  Marburg virus siRNA sense strand
ucgugaacuuuugcuauugau

SEQ ID NO: 29197 - RNA, 21 nt, Artificial Sequence
  Marburg virus siRNA sense strand
cgugaacuuuugcuauugaug

SEQ ID NO: 29198 - RNA, 21 nt, Artificial Sequence
  Marburg virus siRNA sense strand
gugaacuuuugcuauugaugg

SEQ ID NO: 29199 - RNA, 21 nt, Artificial Sequence
  Marburg virus siRNA sense strand
ugaacuuuugcuauugauggc

SEQ ID NO: 29200 - RNA, 21 nt, Artificial Sequence
  Marburg virus siRNA sense strand
gaacuuuugcuauugauggcc

SEQ ID NO: 29201 - RNA, 21 nt, Artificial Sequence
  Marburg virus siRNA sense strand
aacuuuugcuauugauggccc

SEQ ID NO: 29202 - RNA, 21 nt, Artificial Sequence
  Marburg virus siRNA sense strand
acuuuugcuauugauggcccg

SEQ ID NO: 29203 - RNA, 21 nt, Artificial Sequence
  Marburg virus siRNA sense strand
cuuuugcuauugauggcccga

SEQ ID NO: 29204 - RNA, 21 nt, Artificial Sequence
  Marburg virus siRNA sense strand
uuuugcuauugauggcccgaa

SEQ ID NO: 29205 - RNA, 21 nt, Artificial Sequence
  Marburg virus siRNA sense strand
uuugcuauugauggcccgaaa

SEQ ID NO: 29206 - RNA, 21 nt, Artificial Sequence
  Marburg virus siRNA sense strand
uugcuauugauggcccgaaaa

SEQ ID NO: 29207 - RNA, 21 nt, Artificial Sequence
  Marburg virus siRNA sense strand
ugcuauugauggcccgaaaaa

SEQ ID NO: 29208 - RNA, 21 nt, Artificial Sequence
  Marburg virus siRNA sense strand
gcuauugauggcccgaaaaau

SEQ ID NO: 29209 - RNA, 21 nt, Artificial Sequence
  Marburg virus siRNA sense strand
cuauugauggcccgaaaaaug

SEQ ID NO: 29210 - RNA, 21 nt, Artificial Sequence
  Marburg virus siRNA sense strand
uauugauggcccgaaaaaugc

SEQ ID NO: 29211 - RNA, 21 nt, Artificial Sequence
  Marburg virus siRNA sense strand
auugauggcccgaaaaaugcu

SEQ ID NO: 29212 - RNA, 21 nt, Artificial Sequence
  Marburg virus siRNA sense strand
uugauggcccgaaaaaugcuc

SEQ ID NO: 29213 - RNA, 21 nt, Artificial Sequence
  Marburg virus siRNA sense strand
ugauggcccgaaaaaugcucc

SEQ ID NO: 29214 - RNA, 21 nt, Artificial Sequence
  Marburg virus siRNA sense strand
gauggcccgaaaaaugcuccc

SEQ ID NO: 29215 - RNA, 21 nt, Artificial Sequence
  Marburg virus siRNA sense strand
auggcccgaaaaaugcucccc

SEQ ID NO: 29216 - RNA, 21 nt, Artificial Sequence
  Marburg virus siRNA sense strand
uggcccgaaaaaugcucccca

SEQ ID NO: 29217 - RNA, 21 nt, Artificial Sequence
  Marburg virus siRNA sense strand
ggcccgaaaaaugcuccccaa

SEQ ID NO: 29218 - RNA, 21 nt, Artificial Sequence
  Marburg virus siRNA sense strand
gcccgaaaaaugcuccccaau

SEQ ID NO: 29219 - RNA, 21 nt, Artificial Sequence
  Marburg virus siRNA sense strand
cccgaaaaaugcuccccaaua

SEQ ID NO: 29220 - RNA, 21 nt, Artificial Sequence
  Marburg virus siRNA sense strand
ccgaaaaaugcuccccaauac

SEQ ID NO: 29221 - RNA, 21 nt, Artificial Sequence
  Marburg virus siRNA sense strand
cgaaaaaugcuccccaauaca

SEQ ID NO: 29222 - RNA, 21 nt, Artificial Sequence
  Marburg virus siRNA sense strand
gaaaaaugcuccccaauacag

SEQ ID NO: 29223 - RNA, 21 nt, Artificial Sequence
  Marburg virus siRNA sense strand
aaaaaugcuccccaauacaga

SEQ ID NO: 29224 - RNA, 21 nt, Artificial Sequence
  Marburg virus siRNA sense strand
aaaaugcuccccaauacagac

SEQ ID NO: 29225 - RNA, 21 nt, Artificial Sequence
  Marburg virus siRNA sense strand
aaaugcuccccaauacagaca

SEQ ID NO: 29226 - RNA, 21 nt, Artificial Sequence
  Marburg virus siRNA sense strand
aaugcuccccaauacagacaa

SEQ ID NO: 29227 - RNA, 21 nt, Artificial Sequence
  Marburg virus siRNA sense strand
augcuccccaauacagacaag

SEQ ID NO: 29228 - RNA, 21 nt, Artificial Sequence
  Marburg virus siRNA sense strand
ugcuccccaauacagacaaga

SEQ ID NO: 29229 - RNA, 21 nt, Artificial Sequence
  Marburg virus siRNA sense strand
gcuccccaauacagacaagac

SEQ ID NO: 29230 - RNA, 21 nt, Artificial Sequence
  Marburg virus siRNA sense strand
cuccccaauacagacaagacu

SEQ ID NO: 29231 - RNA, 21 nt, Artificial Sequence
  Marburg virus siRNA sense strand
uccccaauacagacaagacuu

SEQ ID NO: 29232 - RNA, 21 nt, Artificial Sequence
  Marburg virus siRNA sense strand
ccccaauacagacaagacuuu

SEQ ID NO: 29233 - RNA, 21 nt, Artificial Sequence
  Marburg virus siRNA sense strand
cccaauacagacaagacuuuu

SEQ ID NO: 29234 - RNA, 21 nt, Artificial Sequence
  Marburg virus siRNA sense strand
ccaauacagacaagacuuuua

SEQ ID NO: 29235 - RNA, 21 nt, Artificial Sequence
  Marburg virus siRNA sense strand
caauacagacaagacuuuuag

SEQ ID NO: 29236 - RNA, 21 nt, Artificial Sequence
  Marburg virus siRNA sense strand
aauacagacaagacuuuuaga

SEQ ID NO: 29237 - RNA, 21 nt, Artificial Sequence
  Marburg virus siRNA sense strand
auacagacaagacuuuuagaa

SEQ ID NO: 29238 - RNA, 21 nt, Artificial Sequence
  Marburg virus siRNA sense strand
uacagacaagacuuuuagaag

SEQ ID NO: 29239 - RNA, 21 nt, Artificial Sequence
  Marburg virus siRNA sense strand
acagacaagacuuuuagaagu

SEQ ID NO: 29240 - RNA, 21 nt, Artificial Sequence
  Marburg virus siRNA sense strand
cagacaagacuuuuagaaguc

SEQ ID NO: 29241 - RNA, 21 nt, Artificial Sequence
  Marburg virus siRNA sense strand
agacaagacuuuuagaagucu

SEQ ID NO: 29242 - RNA, 21 nt, Artificial Sequence
  Marburg virus siRNA sense strand
gacaagacuuuuagaagucug

SEQ ID NO: 29243 - RNA, 21 nt, Artificial Sequence
  Marburg virus siRNA sense strand
acaagacuuuuagaagucugc

SEQ ID NO: 29244 - RNA, 21 nt, Artificial Sequence
  Marburg virus siRNA sense strand
caagacuuuuagaagucugca

SEQ ID NO: 29245 - RNA, 21 nt, Artificial Sequence
  Marburg virus siRNA sense strand
aagacuuuuagaagucugcag

SEQ ID NO: 29246 - RNA, 21 nt, Artificial Sequence
  Marburg virus siRNA sense strand
agacuuuuagaagucugcagg

SEQ ID NO: 29247 - RNA, 21 nt, Artificial Sequence
  Marburg virus siRNA sense strand
gacuuuuagaagucugcagga

SEQ ID NO: 29248 - RNA, 21 nt, Artificial Sequence
  Marburg virus siRNA sense strand
acuuuuagaagucugcaggau

SEQ ID NO: 29249 - RNA, 21 nt, Artificial Sequence
  Marburg virus siRNA sense strand
cuuuuagaagucugcaggauu

SEQ ID NO: 29250 - RNA, 21 nt, Artificial Sequence
  Marburg virus siRNA sense strand
uuuuagaagucugcaggauug

SEQ ID NO: 29251 - RNA, 21 nt, Artificial Sequence
  Marburg virus siRNA sense strand
uuuagaagucugcaggauugu

SEQ ID NO: 29252 - RNA, 21 nt, Artificial Sequence
  Marburg virus siRNA sense strand
uuagaagucugcaggauugug

SEQ ID NO: 29253 - RNA, 21 nt, Artificial Sequence
  Marburg virus siRNA sense strand
uagaagucugcaggauugugg

SEQ ID NO: 29254 - RNA, 21 nt, Artificial Sequence
  Marburg virus siRNA sense strand
agaagucugcaggauuguggg

SEQ ID NO: 29255 - RNA, 21 nt, Artificial Sequence
  Marburg virus siRNA sense strand
gaagucugcaggauugugggu

SEQ ID NO: 29256 - RNA, 21 nt, Artificial Sequence
  Marburg virus siRNA sense strand
aagucugcaggauuguggguc

SEQ ID NO: 29257 - RNA, 21 nt, Artificial Sequence
  Marburg virus siRNA sense strand
agucugcaggauuguggguca

SEQ ID NO: 29258 - RNA, 21 nt, Artificial Sequence
  Marburg virus siRNA sense strand
gucugcaggauugugggucac

SEQ ID NO: 29259 - RNA, 21 nt, Artificial Sequence
  Marburg virus siRNA sense strand
ucugcaggauugugggucacc

SEQ ID NO: 29260 - RNA, 21 nt, Artificial Sequence
  Marburg virus siRNA sense strand
cugcaggauugugggucaccg

SEQ ID NO: 29261 - RNA, 21 nt, Artificial Sequence
  Marburg virus siRNA sense strand
ugcaggauugugggucaccgu

SEQ ID NO: 29262 - RNA, 21 nt, Artificial Sequence
  Marburg virus siRNA sense strand
gcaggauugugggucaccguc

SEQ ID NO: 29263 - RNA, 21 nt, Artificial Sequence
  Marburg virus siRNA sense strand
caggauugugggucaccgucu

SEQ ID NO: 29264 - RNA, 21 nt, Artificial Sequence
  Marburg virus siRNA sense strand
aggauugugggucaccgucuc

SEQ ID NO: 29265 - RNA, 21 nt, Artificial Sequence
  Marburg virus siRNA sense strand
ggauugugggucaccgucucu

SEQ ID NO: 29266 - RNA, 21 nt, Artificial Sequence
  Marburg virus siRNA sense strand
gauugugggucaccgucucuu

SEQ ID NO: 29267 - RNA, 21 nt, Artificial Sequence
  Marburg virus siRNA sense strand
auugugggucaccgucucuuu

SEQ ID NO: 29268 - RNA, 21 nt, Artificial Sequence
  Marburg virus siRNA sense strand
uugugggucaccgucucuuuc

SEQ ID NO: 29269 - RNA, 21 nt, Artificial Sequence
  Marburg virus siRNA sense strand
ugugggucaccgucucuuucu

SEQ ID NO: 29270 - RNA, 21 nt, Artificial Sequence
  Marburg virus siRNA sense strand
gugggucaccgucucuuucua

SEQ ID NO: 29271 - RNA, 21 nt, Artificial Sequence
  Marburg virus siRNA sense strand
ugggucaccgucucuuucuaa

SEQ ID NO: 29272 - RNA, 21 nt, Artificial Sequence
  Marburg virus siRNA sense strand
gggucaccgucucuuucuaaa

SEQ ID NO: 29273 - RNA, 21 nt, Artificial Sequence
  Marburg virus siRNA sense strand
ggucaccgucucuuucuaaag

SEQ ID NO: 29274 - RNA, 21 nt, Artificial Sequence
  Marburg virus siRNA sense strand
gucaccgucucuuucuaaagg

SEQ ID NO: 29275 - RNA, 21 nt, Artificial Sequence
  Marburg virus siRNA sense strand
ucaccgucucuuucuaaaggg

SEQ ID NO: 29276 - RNA, 21 nt, Artificial Sequence
  Marburg virus siRNA sense strand
caccgucucuuucuaaagggc

SEQ ID NO: 29277 - RNA, 21 nt, Artificial Sequence
  Marburg virus siRNA sense strand
accgucucuuucuaaagggcu

SEQ ID NO: 29278 - RNA, 21 nt, Artificial Sequence
  Marburg virus siRNA sense strand
ccgucucuuucuaaagggcuc

SEQ ID NO: 29279 - RNA, 21 nt, Artificial Sequence
  Marburg virus siRNA sense strand
cgucucuuucuaaagggcucu

SEQ ID NO: 29280 - RNA, 21 nt, Artificial Sequence
  Marburg virus siRNA sense strand
gucucuuucuaaagggcucuc

SEQ ID NO: 29281 - RNA, 21 nt, Artificial Sequence
  Marburg virus siRNA sense strand
ucucuuucuaaagggcucuca

SEQ ID NO: 29282 - RNA, 21 nt, Artificial Sequence
  Marburg virus siRNA sense strand
cucuuucuaaagggcucucaa

SEQ ID NO: 29283 - RNA, 21 nt, Artificial Sequence
  Marburg virus siRNA sense strand
ucuuucuaaagggcucucaaa

SEQ ID NO: 29284 - RNA, 21 nt, Artificial Sequence
  Marburg virus siRNA sense strand
cuuucuaaagggcucucaaaa

SEQ ID NO: 29285 - RNA, 21 nt, Artificial Sequence
  Marburg virus siRNA sense strand
uuucuaaagggcucucaaaag

SEQ ID NO: 29286 - RNA, 21 nt, Artificial Sequence
  Marburg virus siRNA sense strand
uucuaaagggcucucaaaaga

SEQ ID NO: 29287 - RNA, 21 nt, Artificial Sequence
  Marburg virus siRNA sense strand
ucuaaagggcucucaaaagau

SEQ ID NO: 29288 - RNA, 21 nt, Artificial Sequence
  Marburg virus siRNA sense strand
cuaaagggcucucaaaagaua

SEQ ID NO: 29289 - RNA, 21 nt, Artificial Sequence
  Marburg virus siRNA sense strand
uaaagggcucucaaaagauaa

SEQ ID NO: 29290 - RNA, 21 nt, Artificial Sequence
  Marburg virus siRNA sense strand
aaagggcucucaaaagauaaa

SEQ ID NO: 29291 - RNA, 21 nt, Artificial Sequence
  Marburg virus siRNA sense strand
aagggcucucaaaagauaaac

SEQ ID NO: 29292 - RNA, 21 nt, Artificial Sequence
  Marburg virus siRNA sense strand
agggcucucaaaagauaaaca

SEQ ID NO: 29293 - RNA, 21 nt, Artificial Sequence
  Marburg virus siRNA sense strand
gggcucucaaaagauaaacag

SEQ ID NO: 29294 - RNA, 21 nt, Artificial Sequence
  Marburg virus siRNA sense strand
ggcucucaaaagauaaacagg

SEQ ID NO: 29295 - RNA, 21 nt, Artificial Sequence
  Marburg virus siRNA sense strand
gcucucaaaagauaaacagga

SEQ ID NO: 29296 - RNA, 21 nt, Artificial Sequence
  Marburg virus siRNA sense strand
cucucaaaagauaaacaggag

SEQ ID NO: 29297 - RNA, 21 nt, Artificial Sequence
  Marburg virus siRNA sense strand
ucucaaaagauaaacaggagc

SEQ ID NO: 29298 - RNA, 21 nt, Artificial Sequence
  Marburg virus siRNA sense strand
cucaaaagauaaacaggagca

SEQ ID NO: 29299 - RNA, 21 nt, Artificial Sequence
  Marburg virus siRNA sense strand
ucaaaagauaaacaggagcaa

SEQ ID NO: 29300 - RNA, 21 nt, Artificial Sequence
  Marburg virus siRNA sense strand
caaaagauaaacaggagcaaa

SEQ ID NO: 29301 - RNA, 21 nt, Artificial Sequence
  Marburg virus siRNA sense strand
aaaagauaaacaggagcaaac

SEQ ID NO: 29302 - RNA, 21 nt, Artificial Sequence
  Marburg virus siRNA sense strand
aaagauaaacaggagcaaacg

SEQ ID NO: 29303 - RNA, 21 nt, Artificial Sequence
  Marburg virus siRNA sense strand
aagauaaacaggagcaaacga

SEQ ID NO: 29304 - RNA, 21 nt, Artificial Sequence
  Marburg virus siRNA sense strand
agauaaacaggagcaaacgaa

SEQ ID NO: 29305 - RNA, 21 nt, Artificial Sequence
  Marburg virus siRNA sense strand
gauaaacaggagcaaacgaaa

SEQ ID NO: 29306 - RNA, 21 nt, Artificial Sequence
  Marburg virus siRNA sense strand
auaaacaggagcaaacgaaag

SEQ ID NO: 29307 - RNA, 21 nt, Artificial Sequence
  Marburg virus siRNA sense strand
uaaacaggagcaaacgaaaga

SEQ ID NO: 29308 - RNA, 21 nt, Artificial Sequence
  Marburg virus siRNA sense strand
aaacaggagcaaacgaaagau

SEQ ID NO: 29309 - RNA, 21 nt, Artificial Sequence
  Marburg virus siRNA sense strand
aacaggagcaaacgaaagaug

SEQ ID NO: 29310 - RNA, 21 nt, Artificial Sequence
  Marburg virus siRNA sense strand
acaggagcaaacgaaagaugu

SEQ ID NO: 29311 - RNA, 21 nt, Artificial Sequence
  Marburg virus siRNA sense strand
caggagcaaacgaaagaugug

SEQ ID NO: 29312 - RNA, 21 nt, Artificial Sequence
  Marburg virus siRNA sense strand
aggagcaaacgaaagaugugu

SEQ ID NO: 29313 - RNA, 21 nt, Artificial Sequence
  Marburg virus siRNA sense strand
ggagcaaacgaaagauguguu

SEQ ID NO: 29314 - RNA, 21 nt, Artificial Sequence
  Marburg virus siRNA sense strand
gagcaaacgaaagauguguug

SEQ ID NO: 29315 - RNA, 21 nt, Artificial Sequence
  Marburg virus siRNA sense strand
agcaaacgaaagauguguuga

SEQ ID NO: 29316 - RNA, 21 nt, Artificial Sequence
  Marburg virus siRNA sense strand
gcaaacgaaagauguguugac

SEQ ID NO: 29317 - RNA, 21 nt, Artificial Sequence
  Marburg virus siRNA sense strand
caaacgaaagauguguugacc

SEQ ID NO: 29318 - RNA, 21 nt, Artificial Sequence
  Marburg virus siRNA sense strand
aaacgaaagauguguugaccu

SEQ ID NO: 29319 - RNA, 21 nt, Artificial Sequence
  Marburg virus siRNA sense strand
aacgaaagauguguugaccuu

SEQ ID NO: 29320 - RNA, 21 nt, Artificial Sequence
  Marburg virus siRNA sense strand
acgaaagauguguugaccuug

SEQ ID NO: 29321 - RNA, 21 nt, Artificial Sequence
  Marburg virus siRNA sense strand
cgaaagauguguugaccuugg

SEQ ID NO: 29322 - RNA, 21 nt, Artificial Sequence
  Marburg virus siRNA sense strand
gaaagauguguugaccuugga

SEQ ID NO: 29323 - RNA, 21 nt, Artificial Sequence
  Marburg virus siRNA sense strand
aaagauguguugaccuuggaa

SEQ ID NO: 29324 - RNA, 21 nt, Artificial Sequence
  Marburg virus siRNA sense strand
aagauguguugaccuuggaaa

SEQ ID NO: 29325 - RNA, 21 nt, Artificial Sequence
  Marburg virus siRNA sense strand
agauguguugaccuuggaaaa

SEQ ID NO: 29326 - RNA, 21 nt, Artificial Sequence
  Marburg virus siRNA sense strand
gauguguugaccuuggaaaau

SEQ ID NO: 29327 - RNA, 21 nt, Artificial Sequence
  Marburg virus siRNA sense strand
auguguugaccuuggaaaauc

SEQ ID NO: 29328 - RNA, 21 nt, Artificial Sequence
  Marburg virus siRNA sense strand
uguguugaccuuggaaaaucu

SEQ ID NO: 29329 - RNA, 21 nt, Artificial Sequence
  Marburg virus siRNA sense strand
guguugaccuuggaaaaucua

SEQ ID NO: 29330 - RNA, 21 nt, Artificial Sequence
  Marburg virus siRNA sense strand
uguugaccuuggaaaaucuag

SEQ ID NO: 29331 - RNA, 21 nt, Artificial Sequence
  Marburg virus siRNA sense strand
guugaccuuggaaaaucuagg

SEQ ID NO: 29332 - RNA, 21 nt, Artificial Sequence
  Marburg virus siRNA sense strand
uugaccuuggaaaaucuagga

SEQ ID NO: 29333 - RNA, 21 nt, Artificial Sequence
  Marburg virus siRNA sense strand
ugaccuuggaaaaucuaggac

SEQ ID NO: 29334 - RNA, 21 nt, Artificial Sequence
  Marburg virus siRNA sense strand
gaccuuggaaaaucuaggaca

SEQ ID NO: 29335 - RNA, 21 nt, Artificial Sequence
  Marburg virus siRNA sense strand
accuuggaaaaucuaggacac

SEQ ID NO: 29336 - RNA, 21 nt, Artificial Sequence
  Marburg virus siRNA sense strand
ccuuggaaaaucuaggacaca

SEQ ID NO: 29337 - RNA, 21 nt, Artificial Sequence
  Marburg virus siRNA sense strand
cuuggaaaaucuaggacacau

SEQ ID NO: 29338 - RNA, 21 nt, Artificial Sequence
  Marburg virus siRNA sense strand
uuggaaaaucuaggacacauu

SEQ ID NO: 29339 - RNA, 21 nt, Artificial Sequence
  Marburg virus siRNA sense strand
uggaaaaucuaggacacauuc

SEQ ID NO: 29340 - RNA, 21 nt, Artificial Sequence
  Marburg virus siRNA sense strand
ggaaaaucuaggacacauucu

SEQ ID NO: 29341 - RNA, 21 nt, Artificial Sequence
  Marburg virus siRNA sense strand
gaaaaucuaggacacauucug

SEQ ID NO: 29342 - RNA, 21 nt, Artificial Sequence
  Marburg virus siRNA sense strand
aaaaucuaggacacauucuga

SEQ ID NO: 29343 - RNA, 21 nt, Artificial Sequence
  Marburg virus siRNA sense strand
aaaucuaggacacauucugaa

SEQ ID NO: 29344 - RNA, 21 nt, Artificial Sequence
  Marburg virus siRNA sense strand
aaucuaggacacauucugaac

SEQ ID NO: 29345 - RNA, 21 nt, Artificial Sequence
  Marburg virus siRNA sense strand
aucuaggacacauucugaacu

SEQ ID NO: 29346 - RNA, 21 nt, Artificial Sequence
  Marburg virus siRNA sense strand
ucuaggacacauucugaacua

SEQ ID NO: 29347 - RNA, 21 nt, Artificial Sequence
  Marburg virus siRNA sense strand
cuaggacacauucugaacuac

SEQ ID NO: 29348 - RNA, 21 nt, Artificial Sequence
  Marburg virus siRNA sense strand
uaggacacauucugaacuacc

SEQ ID NO: 29349 - RNA, 21 nt, Artificial Sequence
  Marburg virus siRNA sense strand
aggacacauucugaacuaccu

SEQ ID NO: 29350 - RNA, 21 nt, Artificial Sequence
  Marburg virus siRNA sense strand
ggacacauucugaacuaccuc

SEQ ID NO: 29351 - RNA, 21 nt, Artificial Sequence
  Marburg virus siRNA sense strand
gacacauucugaacuaccucc

SEQ ID NO: 29352 - RNA, 21 nt, Artificial Sequence
  Marburg virus siRNA sense strand
acacauucugaacuaccucca

SEQ ID NO: 29353 - RNA, 21 nt, Artificial Sequence
  Marburg virus siRNA sense strand
cacauucugaacuaccuccac

SEQ ID NO: 29354 - RNA, 21 nt, Artificial Sequence
  Marburg virus siRNA sense strand
acauucugaacuaccuccaca

SEQ ID NO: 29355 - RNA, 21 nt, Artificial Sequence
  Marburg virus siRNA sense strand
cauucugaacuaccuccacag

SEQ ID NO: 29356 - RNA, 21 nt, Artificial Sequence
  Marburg virus siRNA sense strand
auucugaacuaccuccacaga

SEQ ID NO: 29357 - RNA, 21 nt, Artificial Sequence
  Marburg virus siRNA sense strand
uucugaacuaccuccacagau

SEQ ID NO: 29358 - RNA, 21 nt, Artificial Sequence
  Marburg virus siRNA sense strand
ucugaacuaccuccacagauc

SEQ ID NO: 29359 - RNA, 21 nt, Artificial Sequence
  Marburg virus siRNA sense strand
cugaacuaccuccacagauca

SEQ ID NO: 29360 - RNA, 21 nt, Artificial Sequence
  Marburg virus siRNA sense strand
ugaacuaccuccacagaucag

SEQ ID NO: 29361 - RNA, 21 nt, Artificial Sequence
  Marburg virus siRNA sense strand
gaacuaccuccacagaucaga

SEQ ID NO: 29362 - RNA, 21 nt, Artificial Sequence
  Marburg virus siRNA sense strand
aacuaccuccacagaucagau

SEQ ID NO: 29363 - RNA, 21 nt, Artificial Sequence
  Marburg virus siRNA sense strand
acuaccuccacagaucagaua

SEQ ID NO: 29364 - RNA, 21 nt, Artificial Sequence
  Marburg virus siRNA sense strand
cuaccuccacagaucagauau

SEQ ID NO: 29365 - RNA, 21 nt, Artificial Sequence
  Marburg virus siRNA sense strand
uaccuccacagaucagauauu

SEQ ID NO: 29366 - RNA, 21 nt, Artificial Sequence
  Marburg virus siRNA sense strand
accuccacagaucagauauug

SEQ ID NO: 29367 - RNA, 21 nt, Artificial Sequence
  Marburg virus siRNA sense strand
ccuccacagaucagauauugg

SEQ ID NO: 29368 - RNA, 21 nt, Artificial Sequence
  Marburg virus siRNA sense strand
cuccacagaucagauauuggg

SEQ ID NO: 29369 - RNA, 21 nt, Artificial Sequence
  Marburg virus siRNA sense strand
uccacagaucagauauuggga

SEQ ID NO: 29370 - RNA, 21 nt, Artificial Sequence
  Marburg virus siRNA sense strand
ccacagaucagauauugggaa

SEQ ID NO: 29371 - RNA, 21 nt, Artificial Sequence
  Marburg virus siRNA sense strand
cacagaucagauauugggaaa

SEQ ID NO: 29372 - RNA, 21 nt, Artificial Sequence
  Marburg virus siRNA sense strand
acagaucagauauugggaaau

SEQ ID NO: 29373 - RNA, 21 nt, Artificial Sequence
  Marburg virus siRNA sense strand
cagaucagauauugggaaauu

SEQ ID NO: 29374 - RNA, 21 nt, Artificial Sequence
  Marburg virus siRNA sense strand
agaucagauauugggaaauug

SEQ ID NO: 29375 - RNA, 21 nt, Artificial Sequence
  Marburg virus siRNA sense strand
gaucagauauugggaaauugg

SEQ ID NO: 29376 - RNA, 21 nt, Artificial Sequence
  Marburg virus siRNA sense strand
aucagauauugggaaauugga

SEQ ID NO: 29377 - RNA, 21 nt, Artificial Sequence
  Marburg virus siRNA sense strand
ucagauauugggaaauuggau

SEQ ID NO: 29378 - RNA, 21 nt, Artificial Sequence
  Marburg virus siRNA sense strand
cagauauugggaaauuggaug

SEQ ID NO: 29379 - RNA, 21 nt, Artificial Sequence
  Marburg virus siRNA sense strand
agauauugggaaauuggauga

SEQ ID NO: 29380 - RNA, 21 nt, Artificial Sequence
  Marburg virus siRNA sense strand
gauauugggaaauuggaugag

SEQ ID NO: 29381 - RNA, 21 nt, Artificial Sequence
  Marburg virus siRNA sense strand
auauugggaaauuggaugaga

SEQ ID NO: 29382 - RNA, 21 nt, Artificial Sequence
  Marburg virus siRNA sense strand
uauugggaaauuggaugagac

SEQ ID NO: 29383 - RNA, 21 nt, Artificial Sequence
  Marburg virus siRNA sense strand
auugggaaauuggaugagaca

SEQ ID NO: 29384 - RNA, 21 nt, Artificial Sequence
  Marburg virus siRNA sense strand
uugggaaauuggaugagacau

SEQ ID NO: 29385 - RNA, 21 nt, Artificial Sequence
  Marburg virus siRNA sense strand
ugggaaauuggaugagacauc

SEQ ID NO: 29386 - RNA, 21 nt, Artificial Sequence
  Marburg virus siRNA sense strand
gggaaauuggaugagacauca

SEQ ID NO: 29387 - RNA, 21 nt, Artificial Sequence
  Marburg virus siRNA sense strand
ggaaauuggaugagacaucac

SEQ ID NO: 29388 - RNA, 21 nt, Artificial Sequence
  Marburg virus siRNA sense strand
gaaauuggaugagacaucacu

SEQ ID NO: 29389 - RNA, 21 nt, Artificial Sequence
  Marburg virus siRNA sense strand
aaauuggaugagacaucacuc

SEQ ID NO: 29390 - RNA, 21 nt, Artificial Sequence
  Marburg virus siRNA sense strand
aauuggaugagacaucacucc

SEQ ID NO: 29391 - RNA, 21 nt, Artificial Sequence
  Marburg virus siRNA sense strand
auuggaugagacaucacuccg

SEQ ID NO: 29392 - RNA, 21 nt, Artificial Sequence
  Marburg virus siRNA sense strand
uuggaugagacaucacuccgu

SEQ ID NO: 29393 - RNA, 21 nt, Artificial Sequence
  Marburg virus siRNA sense strand
uggaugagacaucacuccgug

SEQ ID NO: 29394 - RNA, 21 nt, Artificial Sequence
  Marburg virus siRNA sense strand
ggaugagacaucacuccgugc

SEQ ID NO: 29395 - RNA, 21 nt, Artificial Sequence
  Marburg virus siRNA sense strand
gaugagacaucacuccgugca

SEQ ID NO: 29396 - RNA, 21 nt, Artificial Sequence
  Marburg virus siRNA sense strand
augagacaucacuccgugcag

SEQ ID NO: 29397 - RNA, 21 nt, Artificial Sequence
  Marburg virus siRNA sense strand
ugagacaucacuccgugcagc

SEQ ID NO: 29398 - RNA, 21 nt, Artificial Sequence
  Marburg virus siRNA sense strand
gagacaucacuccgugcagca

SEQ ID NO: 29399 - RNA, 21 nt, Artificial Sequence
  Marburg virus siRNA sense strand
agacaucacuccgugcagcau

SEQ ID NO: 29400 - RNA, 21 nt, Artificial Sequence
  Marburg virus siRNA sense strand
gacaucacuccgugcagcauu

SEQ ID NO: 29401 - RNA, 21 nt, Artificial Sequence
  Marburg virus siRNA sense strand
acaucacuccgugcagcauua

SEQ ID NO: 29402 - RNA, 21 nt, Artificial Sequence
  Marburg virus siRNA sense strand
caucacuccgugcagcauuaa

SEQ ID NO: 29403 - RNA, 21 nt, Artificial Sequence
  Marburg virus siRNA sense strand
aucacuccgugcagcauuaag

SEQ ID NO: 29404 - RNA, 21 nt, Artificial Sequence
  Marburg virus siRNA sense strand
ucacuccgugcagcauuaagu

SEQ ID NO: 29405 - RNA, 21 nt, Artificial Sequence
  Marburg virus siRNA sense strand
cacuccgugcagcauuaaguu

SEQ ID NO: 29406 - RNA, 21 nt, Artificial Sequence
  Marburg virus siRNA sense strand
acuccgugcagcauuaaguuu

SEQ ID NO: 29407 - RNA, 21 nt, Artificial Sequence
  Marburg virus siRNA sense strand
cuccgugcagcauuaaguuug

SEQ ID NO: 29408 - RNA, 21 nt, Artificial Sequence
  Marburg virus siRNA sense strand
uccgugcagcauuaaguuuga

SEQ ID NO: 29409 - RNA, 21 nt, Artificial Sequence
  Marburg virus siRNA sense strand
ccgugcagcauuaaguuugac

SEQ ID NO: 29410 - RNA, 21 nt, Artificial Sequence
  Marburg virus siRNA sense strand
cgugcagcauuaaguuugacg

SEQ ID NO: 29411 - RNA, 21 nt, Artificial Sequence
  Marburg virus siRNA sense strand
gugcagcauuaaguuugacgu

SEQ ID NO: 29412 - RNA, 21 nt, Artificial Sequence
  Marburg virus siRNA sense strand
ugcagcauuaaguuugacgug

SEQ ID NO: 29413 - RNA, 21 nt, Artificial Sequence
  Marburg virus siRNA sense strand
gcagcauuaaguuugacgugc

SEQ ID NO: 29414 - RNA, 21 nt, Artificial Sequence
  Marburg virus siRNA sense strand
cagcauuaaguuugacgugcg

SEQ ID NO: 29415 - RNA, 21 nt, Artificial Sequence
  Marburg virus siRNA sense strand
agcauuaaguuugacgugcgc

SEQ ID NO: 29416 - RNA, 21 nt, Artificial Sequence
  Marburg virus siRNA sense strand
gcauuaaguuugacgugcgcu

SEQ ID NO: 29417 - RNA, 21 nt, Artificial Sequence
  Marburg virus siRNA sense strand
cauuaaguuugacgugcgcug

SEQ ID NO: 29418 - RNA, 21 nt, Artificial Sequence
  Marburg virus siRNA sense strand
auuaaguuugacgugcgcugg

SEQ ID NO: 29419 - RNA, 21 nt, Artificial Sequence
  Marburg virus siRNA sense strand
uuaaguuugacgugcgcugga

SEQ ID NO: 29420 - RNA, 21 nt, Artificial Sequence
  Marburg virus siRNA sense strand
uaaguuugacgugcgcuggaa

SEQ ID NO: 29421 - RNA, 21 nt, Artificial Sequence
  Marburg virus siRNA sense strand
aaguuugacgugcgcuggaau

SEQ ID NO: 29422 - RNA, 21 nt, Artificial Sequence
  Marburg virus siRNA sense strand
aguuugacgugcgcuggaauu

SEQ ID NO: 29423 - RNA, 21 nt, Artificial Sequence
  Marburg virus siRNA sense strand
guuugacgugcgcuggaauuc

SEQ ID NO: 29424 - RNA, 21 nt, Artificial Sequence
  Marburg virus siRNA sense strand
uuugacgugcgcuggaauucg

SEQ ID NO: 29425 - RNA, 21 nt, Artificial Sequence
  Marburg virus siRNA sense strand
uugacgugcgcuggaauucga

SEQ ID NO: 29426 - RNA, 21 nt, Artificial Sequence
  Marburg virus siRNA sense strand
ugacgugcgcuggaauucgaa

SEQ ID NO: 29427 - RNA, 21 nt, Artificial Sequence
  Marburg virus siRNA sense strand
gacgugcgcuggaauucgaaa

SEQ ID NO: 29428 - RNA, 21 nt, Artificial Sequence
  Marburg virus siRNA sense strand
acgugcgcuggaauucgaaag

SEQ ID NO: 29429 - RNA, 21 nt, Artificial Sequence
  Marburg virus siRNA sense strand
cgugcgcuggaauucgaaaga

SEQ ID NO: 29430 - RNA, 21 nt, Artificial Sequence
  Marburg virus siRNA sense strand
gugcgcuggaauucgaaagac

SEQ ID NO: 29431 - RNA, 21 nt, Artificial Sequence
  Marburg virus siRNA sense strand
ugcgcuggaauucgaaagacg

SEQ ID NO: 29432 - RNA, 21 nt, Artificial Sequence
  Marburg virus siRNA sense strand
gcgcuggaauucgaaagacga

SEQ ID NO: 29433 - RNA, 21 nt, Artificial Sequence
  Marburg virus siRNA sense strand
cgcuggaauucgaaagacgaa

SEQ ID NO: 29434 - RNA, 21 nt, Artificial Sequence
  Marburg virus siRNA sense strand
gcuggaauucgaaagacgaau

SEQ ID NO: 29435 - RNA, 21 nt, Artificial Sequence
  Marburg virus siRNA sense strand
cuggaauucgaaagacgaaua

SEQ ID NO: 29436 - RNA, 21 nt, Artificial Sequence
  Marburg virus siRNA sense strand
uggaauucgaaagacgaauag

SEQ ID NO: 29437 - RNA, 21 nt, Artificial Sequence
  Marburg virus siRNA sense strand
ggaauucgaaagacgaauaga

SEQ ID NO: 29438 - RNA, 21 nt, Artificial Sequence
  Marburg virus siRNA sense strand
gaauucgaaagacgaauagau

SEQ ID NO: 29439 - RNA, 21 nt, Artificial Sequence
  Marburg virus siRNA sense strand
aauucgaaagacgaauagauc

SEQ ID NO: 29440 - RNA, 21 nt, Artificial Sequence
  Marburg virus siRNA sense strand
auucgaaagacgaauagaucc

SEQ ID NO: 29441 - RNA, 21 nt, Artificial Sequence
  Marburg virus siRNA sense strand
uucgaaagacgaauagauccu

SEQ ID NO: 29442 - RNA, 21 nt, Artificial Sequence
  Marburg virus siRNA sense strand
ucgaaagacgaauagauccuu

SEQ ID NO: 29443 - RNA, 21 nt, Artificial Sequence
  Marburg virus siRNA sense strand
cgaaagacgaauagauccuug

SEQ ID NO: 29444 - RNA, 21 nt, Artificial Sequence
  Marburg virus siRNA sense strand
gaaagacgaauagauccuuga

SEQ ID NO: 29445 - RNA, 21 nt, Artificial Sequence
  Marburg virus siRNA sense strand
aaagacgaauagauccuugau

SEQ ID NO: 29446 - RNA, 21 nt, Artificial Sequence
  Marburg virus siRNA sense strand
aagacgaauagauccuugauc

SEQ ID NO: 29447 - RNA, 21 nt, Artificial Sequence
  Marburg virus siRNA sense strand
agacgaauagauccuugauca

SEQ ID NO: 29448 - RNA, 21 nt, Artificial Sequence
  Marburg virus siRNA sense strand
gacgaauagauccuugaucaa

SEQ ID NO: 29449 - RNA, 21 nt, Artificial Sequence
  Marburg virus siRNA sense strand
acgaauagauccuugaucaac

SEQ ID NO: 29450 - RNA, 21 nt, Artificial Sequence
  Marburg virus siRNA sense strand
cgaauagauccuugaucaaca

SEQ ID NO: 29451 - RNA, 21 nt, Artificial Sequence
  Marburg virus siRNA sense strand
gaauagauccuugaucaacac

SEQ ID NO: 29452 - RNA, 21 nt, Artificial Sequence
  Marburg virus siRNA sense strand
aauagauccuugaucaacacc

SEQ ID NO: 29453 - RNA, 21 nt, Artificial Sequence
  Marburg virus siRNA sense strand
auagauccuugaucaacacca

SEQ ID NO: 29454 - RNA, 21 nt, Artificial Sequence
  Marburg virus siRNA sense strand
uagauccuugaucaacaccau

SEQ ID NO: 29455 - RNA, 21 nt, Artificial Sequence
  Marburg virus siRNA sense strand
agauccuugaucaacaccaug

SEQ ID NO: 29456 - RNA, 21 nt, Artificial Sequence
  Marburg virus siRNA sense strand
gauccuugaucaacaccauga

SEQ ID NO: 29457 - RNA, 21 nt, Artificial Sequence
  Marburg virus siRNA sense strand
auccuugaucaacaccaugac

SEQ ID NO: 29458 - RNA, 21 nt, Artificial Sequence
  Marburg virus siRNA sense strand
uccuugaucaacaccaugacc

SEQ ID NO: 29459 - RNA, 21 nt, Artificial Sequence
  Marburg virus siRNA sense strand
ccuugaucaacaccaugaccg

SEQ ID NO: 29460 - RNA, 21 nt, Artificial Sequence
  Marburg virus siRNA sense strand
cuugaucaacaccaugaccga

SEQ ID NO: 29461 - RNA, 21 nt, Artificial Sequence
  Marburg virus siRNA sense strand
uugaucaacaccaugaccgaa

SEQ ID NO: 29462 - RNA, 21 nt, Artificial Sequence
  Marburg virus siRNA sense strand
ugaucaacaccaugaccgaau

SEQ ID NO: 29463 - RNA, 21 nt, Artificial Sequence
  Marburg virus siRNA sense strand
gaucaacaccaugaccgaauu

SEQ ID NO: 29464 - RNA, 21 nt, Artificial Sequence
  Marburg virus siRNA sense strand
aucaacaccaugaccgaauua

SEQ ID NO: 29465 - RNA, 21 nt, Artificial Sequence
  Marburg virus siRNA sense strand
ucaacaccaugaccgaauuac

SEQ ID NO: 29466 - RNA, 21 nt, Artificial Sequence
  Marburg virus siRNA sense strand
caacaccaugaccgaauuaca

SEQ ID NO: 29467 - RNA, 21 nt, Artificial Sequence
  Marburg virus siRNA sense strand
aacaccaugaccgaauuacac

SEQ ID NO: 29468 - RNA, 21 nt, Artificial Sequence
  Marburg virus siRNA sense strand
acaccaugaccgaauuacaca

SEQ ID NO: 29469 - RNA, 21 nt, Artificial Sequence
  Marburg virus siRNA sense strand
caccaugaccgaauuacacau

SEQ ID NO: 29470 - RNA, 21 nt, Artificial Sequence
  Marburg virus siRNA sense strand
accaugaccgaauuacacauu

SEQ ID NO: 29471 - RNA, 21 nt, Artificial Sequence
  Marburg virus siRNA sense strand
ccaugaccgaauuacacauua

SEQ ID NO: 29472 - RNA, 21 nt, Artificial Sequence
  Marburg virus siRNA sense strand
caugaccgaauuacacauuaa

SEQ ID NO: 29473 - RNA, 21 nt, Artificial Sequence
  Marburg virus siRNA sense strand
augaccgaauuacacauuaac

SEQ ID NO: 29474 - RNA, 21 nt, Artificial Sequence
  Marburg virus siRNA sense strand
ugaccgaauuacacauuaacc

SEQ ID NO: 29475 - RNA, 21 nt, Artificial Sequence
  Marburg virus siRNA sense strand
gaccgaauuacacauuaacca

SEQ ID NO: 29476 - RNA, 21 nt, Artificial Sequence
  Marburg virus siRNA sense strand
accgaauuacacauuaaccau

SEQ ID NO: 29477 - RNA, 21 nt, Artificial Sequence
  Marburg virus siRNA sense strand
ccgaauuacacauuaaccaug

SEQ ID NO: 29478 - RNA, 21 nt, Artificial Sequence
  Marburg virus siRNA sense strand
cgaauuacacauuaaccauga

SEQ ID NO: 29479 - RNA, 21 nt, Artificial Sequence
  Marburg virus siRNA sense strand
gaauuacacauuaaccaugaa

SEQ ID NO: 29480 - RNA, 21 nt, Artificial Sequence
  Marburg virus siRNA sense strand
aauuacacauuaaccaugaaa

SEQ ID NO: 29481 - RNA, 21 nt, Artificial Sequence
  Marburg virus siRNA sense strand
auuacacauuaaccaugaaaa

SEQ ID NO: 29482 - RNA, 21 nt, Artificial Sequence
  Marburg virus siRNA sense strand
uuacacauuaaccaugaaaau

SEQ ID NO: 29483 - RNA, 21 nt, Artificial Sequence
  Marburg virus siRNA sense strand
uacacauuaaccaugaaaauc

SEQ ID NO: 29484 - RNA, 21 nt, Artificial Sequence
  Marburg virus siRNA sense strand
acacauuaaccaugaaaaucu

SEQ ID NO: 29485 - RNA, 21 nt, Artificial Sequence
  Marburg virus siRNA sense strand
cacauuaaccaugaaaaucuc

SEQ ID NO: 29486 - RNA, 21 nt, Artificial Sequence
  Marburg virus siRNA sense strand
acauuaaccaugaaaaucucc

SEQ ID NO: 29487 - RNA, 21 nt, Artificial Sequence
  Marburg virus siRNA sense strand
cauuaaccaugaaaaucuccc

SEQ ID NO: 29488 - RNA, 21 nt, Artificial Sequence
  Marburg virus siRNA sense strand
auuaaccaugaaaaucucccg

SEQ ID NO: 29489 - RNA, 21 nt, Artificial Sequence
  Marburg virus siRNA sense strand
uuaaccaugaaaaucucccgc

SEQ ID NO: 29490 - RNA, 21 nt, Artificial Sequence
  Marburg virus siRNA sense strand
uaaccaugaaaaucucccgca

SEQ ID NO: 29491 - RNA, 21 nt, Artificial Sequence
  Marburg virus siRNA sense strand
aaccaugaaaaucucccgcaa

SEQ ID NO: 29492 - RNA, 21 nt, Artificial Sequence
  Marburg virus siRNA sense strand
accaugaaaaucucccgcaag

SEQ ID NO: 29493 - RNA, 21 nt, Artificial Sequence
  Marburg virus siRNA sense strand
ccaugaaaaucucccgcaaga

SEQ ID NO: 29494 - RNA, 21 nt, Artificial Sequence
  Marburg virus siRNA sense strand
caugaaaaucucccgcaagac

SEQ ID NO: 29495 - RNA, 21 nt, Artificial Sequence
  Marburg virus siRNA sense strand
augaaaaucucccgcaagacc

SEQ ID NO: 29496 - RNA, 21 nt, Artificial Sequence
  Marburg virus siRNA sense strand
ugaaaaucucccgcaagacca

SEQ ID NO: 29497 - RNA, 21 nt, Artificial Sequence
  Marburg virus siRNA sense strand
gaaaaucucccgcaagaccaa

SEQ ID NO: 29498 - RNA, 21 nt, Artificial Sequence
  Marburg virus siRNA sense strand
aaaaucucccgcaagaccaaa

SEQ ID NO: 29499 - RNA, 21 nt, Artificial Sequence
  Marburg virus siRNA sense strand
aaaucucccgcaagaccaaaa

SEQ ID NO: 29500 - RNA, 21 nt, Artificial Sequence
  Marburg virus siRNA sense strand
aaucucccgcaagaccaaaac

SEQ ID NO: 29501 - RNA, 21 nt, Artificial Sequence
  Marburg virus siRNA sense strand
aucucccgcaagaccaaaacg

SEQ ID NO: 29502 - RNA, 21 nt, Artificial Sequence
  Marburg virus siRNA sense strand
ucucccgcaagaccaaaacgg

SEQ ID NO: 29503 - RNA, 21 nt, Artificial Sequence
  Marburg virus siRNA sense strand
cucccgcaagaccaaaacggu

SEQ ID NO: 29504 - RNA, 21 nt, Artificial Sequence
  Marburg virus siRNA sense strand
ucccgcaagaccaaaacggug

SEQ ID NO: 29505 - RNA, 21 nt, Artificial Sequence
  Marburg virus siRNA sense strand
cccgcaagaccaaaacggugu

SEQ ID NO: 29506 - RNA, 21 nt, Artificial Sequence
  Marburg virus siRNA sense strand
ccgcaagaccaaaacgguguu

SEQ ID NO: 29507 - RNA, 21 nt, Artificial Sequence
  Marburg virus siRNA sense strand
cgcaagaccaaaacgguguua

SEQ ID NO: 29508 - RNA, 21 nt, Artificial Sequence
  Marburg virus siRNA sense strand
gcaagaccaaaacgguguuau

SEQ ID NO: 29509 - RNA, 21 nt, Artificial Sequence
  Marburg virus siRNA sense strand
caagaccaaaacgguguuauc

SEQ ID NO: 29510 - RNA, 21 nt, Artificial Sequence
  Marburg virus siRNA sense strand
aagaccaaaacgguguuauca

SEQ ID NO: 29511 - RNA, 21 nt, Artificial Sequence
  Marburg virus siRNA sense strand
agaccaaaacgguguuaucaa

SEQ ID NO: 29512 - RNA, 21 nt, Artificial Sequence
  Marburg virus siRNA sense strand
gaccaaaacgguguuaucaaa

SEQ ID NO: 29513 - RNA, 21 nt, Artificial Sequence
  Marburg virus siRNA sense strand
accaaaacgguguuaucaaac

SEQ ID NO: 29514 - RNA, 21 nt, Artificial Sequence
  Marburg virus siRNA sense strand
ccaaaacgguguuaucaaaca

SEQ ID NO: 29515 - RNA, 21 nt, Artificial Sequence
  Marburg virus siRNA sense strand
caaaacgguguuaucaaacag

SEQ ID NO: 29516 - RNA, 21 nt, Artificial Sequence
  Marburg virus siRNA sense strand
aaaacgguguuaucaaacaga

SEQ ID NO: 29517 - RNA, 21 nt, Artificial Sequence
  Marburg virus siRNA sense strand
aaacgguguuaucaaacagac

SEQ ID NO: 29518 - RNA, 21 nt, Artificial Sequence
  Marburg virus siRNA sense strand
aacgguguuaucaaacagaca

SEQ ID NO: 29519 - RNA, 21 nt, Artificial Sequence
  Marburg virus siRNA sense strand
acgguguuaucaaacagacau

SEQ ID NO: 29520 - RNA, 21 nt, Artificial Sequence
  Marburg virus siRNA sense strand
cgguguuaucaaacagacaua

SEQ ID NO: 29521 - RNA, 21 nt, Artificial Sequence
  Marburg virus siRNA sense strand
gguguuaucaaacagacauau

SEQ ID NO: 29522 - RNA, 21 nt, Artificial Sequence
  Marburg virus siRNA sense strand
guguuaucaaacagacauaua

SEQ ID NO: 29523 - RNA, 21 nt, Artificial Sequence
  Marburg virus siRNA sense strand
uguuaucaaacagacauauac

SEQ ID NO: 29524 - RNA, 21 nt, Artificial Sequence
  Marburg virus siRNA sense strand
guuaucaaacagacauauaca

SEQ ID NO: 29525 - RNA, 21 nt, Artificial Sequence
  Marburg virus siRNA sense strand
uuaucaaacagacauauacag

SEQ ID NO: 29526 - RNA, 21 nt, Artificial Sequence
  Marburg virus siRNA sense strand
uaucaaacagacauauacagg

SEQ ID NO: 29527 - RNA, 21 nt, Artificial Sequence
  Marburg virus siRNA sense strand
aucaaacagacauauacaggu

SEQ ID NO: 29528 - RNA, 21 nt, Artificial Sequence
  Marburg virus siRNA sense strand
ucaaacagacauauacaggua

SEQ ID NO: 29529 - RNA, 21 nt, Artificial Sequence
  Marburg virus siRNA sense strand
caaacagacauauacagguau

SEQ ID NO: 29530 - RNA, 21 nt, Artificial Sequence
  Marburg virus siRNA sense strand
aaacagacauauacagguauu

SEQ ID NO: 29531 - RNA, 21 nt, Artificial Sequence
  Marburg virus siRNA sense strand
aacagacauauacagguauuc

SEQ ID NO: 29532 - RNA, 21 nt, Artificial Sequence
  Marburg virus siRNA sense strand
acagacauauacagguauuca

SEQ ID NO: 29533 - RNA, 21 nt, Artificial Sequence
  Marburg virus siRNA sense strand
cagacauauacagguauucac

SEQ ID NO: 29534 - RNA, 21 nt, Artificial Sequence
  Marburg virus siRNA sense strand
agacauauacagguauucacc

SEQ ID NO: 29535 - RNA, 21 nt, Artificial Sequence
  Marburg virus siRNA sense strand
gacauauacagguauucaccu

SEQ ID NO: 29536 - RNA, 21 nt, Artificial Sequence
  Marburg virus siRNA sense strand
acauauacagguauucaccuu

SEQ ID NO: 29537 - RNA, 21 nt, Artificial Sequence
  Marburg virus siRNA sense strand
cauauacagguauucaccuug

SEQ ID NO: 29538 - RNA, 21 nt, Artificial Sequence
  Marburg virus siRNA sense strand
auauacagguauucaccuuga

SEQ ID NO: 29539 - RNA, 21 nt, Artificial Sequence
  Marburg virus siRNA sense strand
uauacagguauucaccuugac

SEQ ID NO: 29540 - RNA, 21 nt, Artificial Sequence
  Marburg virus siRNA sense strand
auacagguauucaccuugaca

SEQ ID NO: 29541 - RNA, 21 nt, Artificial Sequence
  Marburg virus siRNA sense strand
uacagguauucaccuugacaa

SEQ ID NO: 29542 - RNA, 21 nt, Artificial Sequence
  Marburg virus siRNA sense strand
acagguauucaccuugacaaa

SEQ ID NO: 29543 - RNA, 21 nt, Artificial Sequence
  Marburg virus siRNA sense strand
cagguauucaccuugacaaag

SEQ ID NO: 29544 - RNA, 21 nt, Artificial Sequence
  Marburg virus siRNA sense strand
agguauucaccuugacaaagg

SEQ ID NO: 29545 - RNA, 21 nt, Artificial Sequence
  Marburg virus siRNA sense strand
gguauucaccuugacaaagga

SEQ ID NO: 29546 - RNA, 21 nt, Artificial Sequence
  Marburg virus siRNA sense strand
guauucaccuugacaaaggag

SEQ ID NO: 29547 - RNA, 21 nt, Artificial Sequence
  Marburg virus siRNA sense strand
uauucaccuugacaaaggagg

SEQ ID NO: 29548 - RNA, 21 nt, Artificial Sequence
  Marburg virus siRNA sense strand
auucaccuugacaaaggaggu

SEQ ID NO: 29549 - RNA, 21 nt, Artificial Sequence
  Marburg virus siRNA sense strand
uucaccuugacaaaggagguc

SEQ ID NO: 29550 - RNA, 21 nt, Artificial Sequence
  Marburg virus siRNA sense strand
ucaccuugacaaaggagguca

SEQ ID NO: 29551 - RNA, 21 nt, Artificial Sequence
  Marburg virus siRNA sense strand
caccuugacaaaggaggucaa

SEQ ID NO: 29552 - RNA, 21 nt, Artificial Sequence
  Marburg virus siRNA sense strand
accuugacaaaggaggucaau

SEQ ID NO: 29553 - RNA, 21 nt, Artificial Sequence
  Marburg virus siRNA sense strand
ccuugacaaaggaggucaauu

SEQ ID NO: 29554 - RNA, 21 nt, Artificial Sequence
  Marburg virus siRNA sense strand
cuugacaaaggaggucaauuc

SEQ ID NO: 29555 - RNA, 21 nt, Artificial Sequence
  Marburg virus siRNA sense strand
uugacaaaggaggucaauucg

SEQ ID NO: 29556 - RNA, 21 nt, Artificial Sequence
  Marburg virus siRNA sense strand
ugacaaaggaggucaauucga

SEQ ID NO: 29557 - RNA, 21 nt, Artificial Sequence
  Marburg virus siRNA sense strand
gacaaaggaggucaauucgaa

SEQ ID NO: 29558 - RNA, 21 nt, Artificial Sequence
  Marburg virus siRNA sense strand
acaaaggaggucaauucgaag

SEQ ID NO: 29559 - RNA, 21 nt, Artificial Sequence
  Marburg virus siRNA sense strand
caaaggaggucaauucgaagc

SEQ ID NO: 29560 - RNA, 21 nt, Artificial Sequence
  Marburg virus siRNA sense strand
aaaggaggucaauucgaagcc

SEQ ID NO: 29561 - RNA, 21 nt, Artificial Sequence
  Marburg virus siRNA sense strand
aaggaggucaauucgaagccg

SEQ ID NO: 29562 - RNA, 21 nt, Artificial Sequence
  Marburg virus siRNA sense strand
aggaggucaauucgaagccgc

SEQ ID NO: 29563 - RNA, 21 nt, Artificial Sequence
  Marburg virus siRNA sense strand
ggaggucaauucgaagccgcc

SEQ ID NO: 29564 - RNA, 21 nt, Artificial Sequence
  Marburg virus siRNA sense strand
gaggucaauucgaagccgccu

SEQ ID NO: 29565 - RNA, 21 nt, Artificial Sequence
  Marburg virus siRNA sense strand
aggucaauucgaagccgccuu

SEQ ID NO: 29566 - RNA, 21 nt, Artificial Sequence
  Marburg virus siRNA sense strand
ggucaauucgaagccgccuua

SEQ ID NO: 29567 - RNA, 21 nt, Artificial Sequence
  Marburg virus siRNA sense strand
gucaauucgaagccgccuuau

SEQ ID NO: 29568 - RNA, 21 nt, Artificial Sequence
  Marburg virus siRNA sense strand
ucaauucgaagccgccuuaug

SEQ ID NO: 29569 - RNA, 21 nt, Artificial Sequence
  Marburg virus siRNA sense strand
caauucgaagccgccuuaugg

SEQ ID NO: 29570 - RNA, 21 nt, Artificial Sequence
  Marburg virus siRNA sense strand
aauucgaagccgccuuauggc

SEQ ID NO: 29571 - RNA, 21 nt, Artificial Sequence
  Marburg virus siRNA sense strand
auucgaagccgccuuauggca

SEQ ID NO: 29572 - RNA, 21 nt, Artificial Sequence
  Marburg virus siRNA sense strand
uucgaagccgccuuauggcaa

SEQ ID NO: 29573 - RNA, 21 nt, Artificial Sequence
  Marburg virus siRNA sense strand
ucgaagccgccuuauggcaag

SEQ ID NO: 29574 - RNA, 21 nt, Artificial Sequence
  Marburg virus siRNA sense strand
cgaagccgccuuauggcaagg

SEQ ID NO: 29575 - RNA, 21 nt, Artificial Sequence
  Marburg virus siRNA sense strand
gaagccgccuuauggcaaggu

SEQ ID NO: 29576 - RNA, 21 nt, Artificial Sequence
  Marburg virus siRNA sense strand
aagccgccuuauggcaagguu

SEQ ID NO: 29577 - RNA, 21 nt, Artificial Sequence
  Marburg virus siRNA sense strand
agccgccuuauggcaagguug

SEQ ID NO: 29578 - RNA, 21 nt, Artificial Sequence
  Marburg virus siRNA sense strand
gccgccuuauggcaagguugg

SEQ ID NO: 29579 - RNA, 21 nt, Artificial Sequence
  Marburg virus siRNA sense strand
ccgccuuauggcaagguuggg

SEQ ID NO: 29580 - RNA, 21 nt, Artificial Sequence
  Marburg virus siRNA sense strand
cgccuuauggcaagguuggga

SEQ ID NO: 29581 - RNA, 21 nt, Artificial Sequence
  Marburg virus siRNA sense strand
gccuuauggcaagguugggau

SEQ ID NO: 29582 - RNA, 21 nt, Artificial Sequence
  Marburg virus siRNA sense strand
ccuuauggcaagguugggaua

SEQ ID NO: 29583 - RNA, 21 nt, Artificial Sequence
  Marburg virus siRNA sense strand
cuuauggcaagguugggauaa

SEQ ID NO: 29584 - RNA, 21 nt, Artificial Sequence
  Marburg virus siRNA sense strand
uuauggcaagguugggauaag

SEQ ID NO: 29585 - RNA, 21 nt, Artificial Sequence
  Marburg virus siRNA sense strand
uauggcaagguugggauaaga

SEQ ID NO: 29586 - RNA, 21 nt, Artificial Sequence
  Marburg virus siRNA sense strand
auggcaagguugggauaagag

SEQ ID NO: 29587 - RNA, 21 nt, Artificial Sequence
  Marburg virus siRNA sense strand
uggcaagguugggauaagaga

SEQ ID NO: 29588 - RNA, 21 nt, Artificial Sequence
  Marburg virus siRNA sense strand
ggcaagguugggauaagagau

SEQ ID NO: 29589 - RNA, 21 nt, Artificial Sequence
  Marburg virus siRNA sense strand
gcaagguugggauaagagauc

SEQ ID NO: 29590 - RNA, 21 nt, Artificial Sequence
  Marburg virus siRNA sense strand
caagguugggauaagagaucg

SEQ ID NO: 29591 - RNA, 21 nt, Artificial Sequence
  Marburg virus siRNA sense strand
aagguugggauaagagaucga

SEQ ID NO: 29592 - RNA, 21 nt, Artificial Sequence
  Marburg virus siRNA sense strand
agguugggauaagagaucgau

SEQ ID NO: 29593 - RNA, 21 nt, Artificial Sequence
  Marburg virus siRNA sense strand
gguugggauaagagaucgaua

SEQ ID NO: 29594 - RNA, 21 nt, Artificial Sequence
  Marburg virus siRNA sense strand
guugggauaagagaucgauau

SEQ ID NO: 29595 - RNA, 21 nt, Artificial Sequence
  Marburg virus siRNA sense strand
uugggauaagagaucgauauc

SEQ ID NO: 29596 - RNA, 21 nt, Artificial Sequence
  Marburg virus siRNA sense strand
ugggauaagagaucgauaucu

SEQ ID NO: 29597 - RNA, 21 nt, Artificial Sequence
  Marburg virus siRNA sense strand
gggauaagagaucgauaucuu

SEQ ID NO: 29598 - RNA, 21 nt, Artificial Sequence
  Marburg virus siRNA sense strand
ggauaagagaucgauaucuuu

SEQ ID NO: 29599 - RNA, 21 nt, Artificial Sequence
  Marburg virus siRNA sense strand
gauaagagaucgauaucuuua

SEQ ID NO: 29600 - RNA, 21 nt, Artificial Sequence
  Marburg virus siRNA sense strand
auaagagaucgauaucuuuau

SEQ ID NO: 29601 - RNA, 21 nt, Artificial Sequence
  Marburg virus siRNA sense strand
uaagagaucgauaucuuuauu

SEQ ID NO: 29602 - RNA, 21 nt, Artificial Sequence
  Marburg virus siRNA sense strand
aagagaucgauaucuuuauuc

SEQ ID NO: 29603 - RNA, 21 nt, Artificial Sequence
  Marburg virus siRNA sense strand
agagaucgauaucuuuauucg

SEQ ID NO: 29604 - RNA, 21 nt, Artificial Sequence
  Marburg virus siRNA sense strand
gagaucgauaucuuuauucgu

SEQ ID NO: 29605 - RNA, 21 nt, Artificial Sequence
  Marburg virus siRNA sense strand
agaucgauaucuuuauucgua

SEQ ID NO: 29606 - RNA, 21 nt, Artificial Sequence
  Marburg virus siRNA sense strand
gaucgauaucuuuauucguac

SEQ ID NO: 29607 - RNA, 21 nt, Artificial Sequence
  Marburg virus siRNA sense strand
aucgauaucuuuauucguaca

SEQ ID NO: 29608 - RNA, 21 nt, Artificial Sequence
  Marburg virus siRNA sense strand
ucgauaucuuuauucguacaa

SEQ ID NO: 29609 - RNA, 21 nt, Artificial Sequence
  Marburg virus siRNA sense strand
cgauaucuuuauucguacaag

SEQ ID NO: 29610 - RNA, 21 nt, Artificial Sequence
  Marburg virus siRNA sense strand
gauaucuuuauucguacaagc

SEQ ID NO: 29611 - RNA, 21 nt, Artificial Sequence
  Marburg virus siRNA sense strand
auaucuuuauucguacaagca

SEQ ID NO: 29612 - RNA, 21 nt, Artificial Sequence
  Marburg virus siRNA sense strand
uaucuuuauucguacaagcag

SEQ ID NO: 29613 - RNA, 21 nt, Artificial Sequence
  Marburg virus siRNA sense strand
aucuuuauucguacaagcagc

SEQ ID NO: 29614 - RNA, 21 nt, Artificial Sequence
  Marburg virus siRNA sense strand
ucuuuauucguacaagcagcu

SEQ ID NO: 29615 - RNA, 21 nt, Artificial Sequence
  Marburg virus siRNA sense strand
cuuuauucguacaagcagcuu

SEQ ID NO: 29616 - RNA, 21 nt, Artificial Sequence
  Marburg virus siRNA sense strand
uuuauucguacaagcagcuuu

SEQ ID NO: 29617 - RNA, 21 nt, Artificial Sequence
  Marburg virus siRNA sense strand
uuauucguacaagcagcuuua

SEQ ID NO: 29618 - RNA, 21 nt, Artificial Sequence
  Marburg virus siRNA sense strand
uauucguacaagcagcuuuau

SEQ ID NO: 29619 - RNA, 21 nt, Artificial Sequence
  Marburg virus siRNA sense strand
auucguacaagcagcuuuaua

SEQ ID NO: 29620 - RNA, 21 nt, Artificial Sequence
  Marburg virus siRNA sense strand
uucguacaagcagcuuuauau

SEQ ID NO: 29621 - RNA, 21 nt, Artificial Sequence
  Marburg virus siRNA sense strand
ucguacaagcagcuuuauaug

SEQ ID NO: 29622 - RNA, 21 nt, Artificial Sequence
  Marburg virus siRNA sense strand
cguacaagcagcuuuauaugu

SEQ ID NO: 29623 - RNA, 21 nt, Artificial Sequence
  Marburg virus siRNA sense strand
guacaagcagcuuuauaugua

SEQ ID NO: 29624 - RNA, 21 nt, Artificial Sequence
  Marburg virus siRNA sense strand
uacaagcagcuuuauauguaa

SEQ ID NO: 29625 - RNA, 21 nt, Artificial Sequence
  Marburg virus siRNA sense strand
acaagcagcuuuauauguaau

SEQ ID NO: 29626 - RNA, 21 nt, Artificial Sequence
  Marburg virus siRNA sense strand
caagcagcuuuauauguaaug

SEQ ID NO: 29627 - RNA, 21 nt, Artificial Sequence
  Marburg virus siRNA sense strand
aagcagcuuuauauguaauga

SEQ ID NO: 29628 - RNA, 21 nt, Artificial Sequence
  Marburg virus siRNA sense strand
agcagcuuuauauguaaugaa

SEQ ID NO: 29629 - RNA, 21 nt, Artificial Sequence
  Marburg virus siRNA sense strand
gcagcuuuauauguaaugaac

SEQ ID NO: 29630 - RNA, 21 nt, Artificial Sequence
  Marburg virus siRNA sense strand
cagcuuuauauguaaugaaca

SEQ ID NO: 29631 - RNA, 21 nt, Artificial Sequence
  Marburg virus siRNA sense strand
agcuuuauauguaaugaacaa

SEQ ID NO: 29632 - RNA, 21 nt, Artificial Sequence
  Marburg virus siRNA sense strand
gcuuuauauguaaugaacaau

SEQ ID NO: 29633 - RNA, 21 nt, Artificial Sequence
  Marburg virus siRNA sense strand
cuuuauauguaaugaacaaua

SEQ ID NO: 29634 - RNA, 21 nt, Artificial Sequence
  Marburg virus siRNA sense strand
uuuauauguaaugaacaauau

SEQ ID NO: 29635 - RNA, 21 nt, Artificial Sequence
  Marburg virus siRNA sense strand
uuauauguaaugaacaauauc

SEQ ID NO: 29636 - RNA, 21 nt, Artificial Sequence
  Marburg virus siRNA sense strand
uauauguaaugaacaauaucc

SEQ ID NO: 29637 - RNA, 21 nt, Artificial Sequence
  Marburg virus siRNA sense strand
auauguaaugaacaauauccc

SEQ ID NO: 29638 - RNA, 21 nt, Artificial Sequence
  Marburg virus siRNA sense strand
uauguaaugaacaauaucccu

SEQ ID NO: 29639 - RNA, 21 nt, Artificial Sequence
  Marburg virus siRNA sense strand
auguaaugaacaauaucccuu

SEQ ID NO: 29640 - RNA, 21 nt, Artificial Sequence
  Marburg virus siRNA sense strand
uguaaugaacaauaucccuug

SEQ ID NO: 29641 - RNA, 21 nt, Artificial Sequence
  Marburg virus siRNA sense strand
guaaugaacaauaucccuugu

SEQ ID NO: 29642 - RNA, 21 nt, Artificial Sequence
  Marburg virus siRNA sense strand
uaaugaacaauaucccuugug

SEQ ID NO: 29643 - RNA, 21 nt, Artificial Sequence
  Marburg virus siRNA sense strand
aaugaacaauaucccuuguga

SEQ ID NO: 29644 - RNA, 21 nt, Artificial Sequence
  Marburg virus siRNA sense strand
augaacaauaucccuugugaa

SEQ ID NO: 29645 - RNA, 21 nt, Artificial Sequence
  Marburg virus siRNA sense strand
ugaacaauaucccuugugaau

SEQ ID NO: 29646 - RNA, 21 nt, Artificial Sequence
  Marburg virus siRNA sense strand
gaacaauaucccuugugaauc

SEQ ID NO: 29647 - RNA, 21 nt, Artificial Sequence
  Marburg virus siRNA sense strand
aacaauaucccuugugaauca

SEQ ID NO: 29648 - RNA, 21 nt, Artificial Sequence
  Marburg virus siRNA sense strand
acaauaucccuugugaaucau

SEQ ID NO: 29649 - RNA, 21 nt, Artificial Sequence
  Marburg virus siRNA sense strand
caauaucccuugugaaucauc

SEQ ID NO: 29650 - RNA, 21 nt, Artificial Sequence
  Marburg virus siRNA sense strand
aauaucccuugugaaucauca

SEQ ID NO: 29651 - RNA, 21 nt, Artificial Sequence
  Marburg virus siRNA sense strand
auaucccuugugaaucaucaa

SEQ ID NO: 29652 - RNA, 21 nt, Artificial Sequence
  Marburg virus siRNA sense strand
uaucccuugugaaucaucaac

SEQ ID NO: 29653 - RNA, 21 nt, Artificial Sequence
  Marburg virus siRNA sense strand
aucccuugugaaucaucaacc

SEQ ID NO: 29654 - RNA, 21 nt, Artificial Sequence
  Marburg virus siRNA sense strand
ucccuugugaaucaucaacca

SEQ ID NO: 29655 - RNA, 21 nt, Artificial Sequence
  Marburg virus siRNA sense strand
cccuugugaaucaucaaccag

SEQ ID NO: 29656 - RNA, 21 nt, Artificial Sequence
  Marburg virus siRNA sense strand
ccuugugaaucaucaaccagu

SEQ ID NO: 29657 - RNA, 21 nt, Artificial Sequence
  Marburg virus siRNA sense strand
cuugugaaucaucaaccagug

SEQ ID NO: 29658 - RNA, 21 nt, Artificial Sequence
  Marburg virus siRNA sense strand
uugugaaucaucaaccagugu

SEQ ID NO: 29659 - RNA, 21 nt, Artificial Sequence
  Marburg virus siRNA sense strand
ugugaaucaucaaccagugug

SEQ ID NO: 29660 - RNA, 21 nt, Artificial Sequence
  Marburg virus siRNA sense strand
gugaaucaucaaccagugugc

SEQ ID NO: 29661 - RNA, 21 nt, Artificial Sequence
  Marburg virus siRNA sense strand
ugaaucaucaaccagugugca

SEQ ID NO: 29662 - RNA, 21 nt, Artificial Sequence
  Marburg virus siRNA sense strand
gaaucaucaaccagugugcaa

SEQ ID NO: 29663 - RNA, 21 nt, Artificial Sequence
  Marburg virus siRNA sense strand
aaucaucaaccagugugcaag

SEQ ID NO: 29664 - RNA, 21 nt, Artificial Sequence
  Marburg virus siRNA sense strand
aucaucaaccagugugcaagc

SEQ ID NO: 29665 - RNA, 21 nt, Artificial Sequence
  Marburg virus siRNA sense strand
ucaucaaccagugugcaagcc

SEQ ID NO: 29666 - RNA, 21 nt, Artificial Sequence
  Marburg virus siRNA sense strand
caucaaccagugugcaagccu

SEQ ID NO: 29667 - RNA, 21 nt, Artificial Sequence
  Marburg virus siRNA sense strand
aucaaccagugugcaagccuc

SEQ ID NO: 29668 - RNA, 21 nt, Artificial Sequence
  Marburg virus siRNA sense strand
ucaaccagugugcaagccuca

SEQ ID NO: 29669 - RNA, 21 nt, Artificial Sequence
  Marburg virus siRNA sense strand
caaccagugugcaagccucau

SEQ ID NO: 29670 - RNA, 21 nt, Artificial Sequence
  Marburg virus siRNA sense strand
aaccagugugcaagccucaua

SEQ ID NO: 29671 - RNA, 21 nt, Artificial Sequence
  Marburg virus siRNA sense strand
accagugugcaagccucauac

SEQ ID NO: 29672 - RNA, 21 nt, Artificial Sequence
  Marburg virus siRNA sense strand
ccagugugcaagccucauacg

SEQ ID NO: 29673 - RNA, 21 nt, Artificial Sequence
  Marburg virus siRNA sense strand
cagugugcaagccucauacga

SEQ ID NO: 29674 - RNA, 21 nt, Artificial Sequence
  Marburg virus siRNA sense strand
agugugcaagccucauacgau

SEQ ID NO: 29675 - RNA, 21 nt, Artificial Sequence
  Marburg virus siRNA sense strand
gugugcaagccucauacgauc

SEQ ID NO: 29676 - RNA, 21 nt, Artificial Sequence
  Marburg virus siRNA sense strand
ugugcaagccucauacgauca

SEQ ID NO: 29677 - RNA, 21 nt, Artificial Sequence
  Marburg virus siRNA sense strand
gugcaagccucauacgaucau

SEQ ID NO: 29678 - RNA, 21 nt, Artificial Sequence
  Marburg virus siRNA sense strand
ugcaagccucauacgaucauu

SEQ ID NO: 29679 - RNA, 21 nt, Artificial Sequence
  Marburg virus siRNA sense strand
gcaagccucauacgaucauuu

SEQ ID NO: 29680 - RNA, 21 nt, Artificial Sequence
  Marburg virus siRNA sense strand
caagccucauacgaucauuuu

SEQ ID NO: 29681 - RNA, 21 nt, Artificial Sequence
  Marburg virus siRNA sense strand
aagccucauacgaucauuuua

SEQ ID NO: 29682 - RNA, 21 nt, Artificial Sequence
  Marburg virus siRNA sense strand
agccucauacgaucauuuuau

SEQ ID NO: 29683 - RNA, 21 nt, Artificial Sequence
  Marburg virus siRNA sense strand
gccucauacgaucauuuuauu

SEQ ID NO: 29684 - RNA, 21 nt, Artificial Sequence
  Marburg virus siRNA sense strand
ccucauacgaucauuuuauuc

SEQ ID NO: 29685 - RNA, 21 nt, Artificial Sequence
  Marburg virus siRNA sense strand
cucauacgaucauuuuauucu

SEQ ID NO: 29686 - RNA, 21 nt, Artificial Sequence
  Marburg virus siRNA sense strand
ucauacgaucauuuuauucuu

SEQ ID NO: 29687 - RNA, 21 nt, Artificial Sequence
  Marburg virus siRNA sense strand
cauacgaucauuuuauucuuc

SEQ ID NO: 29688 - RNA, 21 nt, Artificial Sequence
  Marburg virus siRNA sense strand
auacgaucauuuuauucuucc

SEQ ID NO: 29689 - RNA, 21 nt, Artificial Sequence
  Marburg virus siRNA sense strand
uacgaucauuuuauucuuccu

SEQ ID NO: 29690 - RNA, 21 nt, Artificial Sequence
  Marburg virus siRNA sense strand
acgaucauuuuauucuuccuc

SEQ ID NO: 29691 - RNA, 21 nt, Artificial Sequence
  Marburg virus siRNA sense strand
cgaucauuuuauucuuccuca

SEQ ID NO: 29692 - RNA, 21 nt, Artificial Sequence
  Marburg virus siRNA sense strand
gaucauuuuauucuuccucaa

SEQ ID NO: 29693 - RNA, 21 nt, Artificial Sequence
  Marburg virus siRNA sense strand
aucauuuuauucuuccucaaa

SEQ ID NO: 29694 - RNA, 21 nt, Artificial Sequence
  Marburg virus siRNA sense strand
ucauuuuauucuuccucaaag

SEQ ID NO: 29695 - RNA, 21 nt, Artificial Sequence
  Marburg virus siRNA sense strand
cauuuuauucuuccucaaagu

SEQ ID NO: 29696 - RNA, 21 nt, Artificial Sequence
  Marburg virus siRNA sense strand
auuuuauucuuccucaaaguc

SEQ ID NO: 29697 - RNA, 21 nt, Artificial Sequence
  Marburg virus siRNA sense strand
uuuuauucuuccucaaaguca

SEQ ID NO: 29698 - RNA, 21 nt, Artificial Sequence
  Marburg virus siRNA sense strand
uuuauucuuccucaaagucaa

SEQ ID NO: 29699 - RNA, 21 nt, Artificial Sequence
  Marburg virus siRNA sense strand
uuauucuuccucaaagucaaa

SEQ ID NO: 29700 - RNA, 21 nt, Artificial Sequence
  Marburg virus siRNA sense strand
uauucuuccucaaagucaaag

SEQ ID NO: 29701 - RNA, 21 nt, Artificial Sequence
  Marburg virus siRNA sense strand
auucuuccucaaagucaaagu

SEQ ID NO: 29702 - RNA, 21 nt, Artificial Sequence
  Marburg virus siRNA sense strand
uucuuccucaaagucaaagua

SEQ ID NO: 29703 - RNA, 21 nt, Artificial Sequence
  Marburg virus siRNA sense strand
ucuuccucaaagucaaaguaa

SEQ ID NO: 29704 - RNA, 21 nt, Artificial Sequence
  Marburg virus siRNA sense strand
cuuccucaaagucaaaguaaa

SEQ ID NO: 29705 - RNA, 21 nt, Artificial Sequence
  Marburg virus siRNA sense strand
uuccucaaagucaaaguaaag

SEQ ID NO: 29706 - RNA, 21 nt, Artificial Sequence
  Marburg virus siRNA sense strand
uccucaaagucaaaguaaagg

SEQ ID NO: 29707 - RNA, 21 nt, Artificial Sequence
  Marburg virus siRNA sense strand
ccucaaagucaaaguaaagga

SEQ ID NO: 29708 - RNA, 21 nt, Artificial Sequence
  Marburg virus siRNA sense strand
cucaaagucaaaguaaaggac

SEQ ID NO: 29709 - RNA, 21 nt, Artificial Sequence
  Marburg virus siRNA sense strand
ucaaagucaaaguaaaggaca

SEQ ID NO: 29710 - RNA, 21 nt, Artificial Sequence
  Marburg virus siRNA sense strand
caaagucaaaguaaaggacaa

SEQ ID NO: 29711 - RNA, 21 nt, Artificial Sequence
  Marburg virus siRNA sense strand
aaagucaaaguaaaggacaau

SEQ ID NO: 29712 - RNA, 21 nt, Artificial Sequence
  Marburg virus siRNA sense strand
aagucaaaguaaaggacaaug

SEQ ID NO: 29713 - RNA, 21 nt, Artificial Sequence
  Marburg virus siRNA sense strand
agucaaaguaaaggacaauga

SEQ ID NO: 29714 - RNA, 21 nt, Artificial Sequence
  Marburg virus siRNA sense strand
gucaaaguaaaggacaaugau

SEQ ID NO: 29715 - RNA, 21 nt, Artificial Sequence
  Marburg virus siRNA sense strand
ucaaaguaaaggacaaugauu

SEQ ID NO: 29716 - RNA, 21 nt, Artificial Sequence
  Marburg virus siRNA sense strand
caaaguaaaggacaaugauua

SEQ ID NO: 29717 - RNA, 21 nt, Artificial Sequence
  Marburg virus siRNA sense strand
aaaguaaaggacaaugauuau

SEQ ID NO: 29718 - RNA, 21 nt, Artificial Sequence
  Marburg virus siRNA sense strand
aaguaaaggacaaugauuauu

SEQ ID NO: 29719 - RNA, 21 nt, Artificial Sequence
  Marburg virus siRNA sense strand
aguaaaggacaaugauuauug

SEQ ID NO: 29720 - RNA, 21 nt, Artificial Sequence
  Marburg virus siRNA sense strand
guaaaggacaaugauuauugu

SEQ ID NO: 29721 - RNA, 21 nt, Artificial Sequence
  Marburg virus siRNA sense strand
uaaaggacaaugauuauuguu

SEQ ID NO: 29722 - RNA, 21 nt, Artificial Sequence
  Marburg virus siRNA sense strand
aaaggacaaugauuauuguuu

SEQ ID NO: 29723 - RNA, 21 nt, Artificial Sequence
  Marburg virus siRNA sense strand
aaggacaaugauuauuguuug

SEQ ID NO: 29724 - RNA, 21 nt, Artificial Sequence
  Marburg virus siRNA sense strand
aggacaaugauuauuguuuga

SEQ ID NO: 29725 - RNA, 21 nt, Artificial Sequence
  Marburg virus siRNA sense strand
ggacaaugauuauuguuugaa

SEQ ID NO: 29726 - RNA, 21 nt, Artificial Sequence
  Marburg virus siRNA sense strand
gacaaugauuauuguuugaaa

SEQ ID NO: 29727 - RNA, 21 nt, Artificial Sequence
  Marburg virus siRNA sense strand
acaaugauuauuguuugaaag

SEQ ID NO: 29728 - RNA, 21 nt, Artificial Sequence
  Marburg virus siRNA sense strand
caaugauuauuguuugaaagu

SEQ ID NO: 29729 - RNA, 21 nt, Artificial Sequence
  Marburg virus siRNA sense strand
aaugauuauuguuugaaaguu

SEQ ID NO: 29730 - RNA, 21 nt, Artificial Sequence
  Marburg virus siRNA sense strand
augauuauuguuugaaaguug

SEQ ID NO: 29731 - RNA, 21 nt, Artificial Sequence
  Marburg virus siRNA sense strand
ugauuauuguuugaaaguuga

SEQ ID NO: 29732 - RNA, 21 nt, Artificial Sequence
  Marburg virus siRNA sense strand
gauuauuguuugaaaguugac

SEQ ID NO: 29733 - RNA, 21 nt, Artificial Sequence
  Marburg virus siRNA sense strand
auuauuguuugaaaguugaca

SEQ ID NO: 29734 - RNA, 21 nt, Artificial Sequence
  Marburg virus siRNA sense strand
uuauuguuugaaaguugacaa

SEQ ID NO: 29735 - RNA, 21 nt, Artificial Sequence
  Marburg virus siRNA sense strand
uauuguuugaaaguugacaau

SEQ ID NO: 29736 - RNA, 21 nt, Artificial Sequence
  Marburg virus siRNA sense strand
auuguuugaaaguugacaauc

SEQ ID NO: 29737 - RNA, 21 nt, Artificial Sequence
  Marburg virus siRNA sense strand
uuguuugaaaguugacaauca

SEQ ID NO: 29738 - RNA, 21 nt, Artificial Sequence
  Marburg virus siRNA sense strand
uguuugaaaguugacaaucaa

SEQ ID NO: 29739 - RNA, 21 nt, Artificial Sequence
  Marburg virus siRNA sense strand
guuugaaaguugacaaucaaa

SEQ ID NO: 29740 - RNA, 21 nt, Artificial Sequence
  Marburg virus siRNA sense strand
uuugaaaguugacaaucaaau

SEQ ID NO: 29741 - RNA, 21 nt, Artificial Sequence
  Marburg virus siRNA sense strand
uugaaaguugacaaucaaauc

SEQ ID NO: 29742 - RNA, 21 nt, Artificial Sequence
  Marburg virus siRNA sense strand
ugaaaguugacaaucaaauca

SEQ ID NO: 29743 - RNA, 21 nt, Artificial Sequence
  Marburg virus siRNA sense strand
gaaaguugacaaucaaaucac

SEQ ID NO: 29744 - RNA, 21 nt, Artificial Sequence
  Marburg virus siRNA sense strand
aaaguugacaaucaaaucacu

SEQ ID NO: 29745 - RNA, 21 nt, Artificial Sequence
  Marburg virus siRNA sense strand
aaguugacaaucaaaucacuu

SEQ ID NO: 29746 - RNA, 21 nt, Artificial Sequence
  Marburg virus siRNA sense strand
aguugacaaucaaaucacuuu

SEQ ID NO: 29747 - RNA, 21 nt, Artificial Sequence
  Marburg virus siRNA sense strand
guugacaaucaaaucacuuuc

SEQ ID NO: 29748 - RNA, 21 nt, Artificial Sequence
  Marburg virus siRNA sense strand
uugacaaucaaaucacuuuca

SEQ ID NO: 29749 - RNA, 21 nt, Artificial Sequence
  Marburg virus siRNA sense strand
ugacaaucaaaucacuuucag

SEQ ID NO: 29750 - RNA, 21 nt, Artificial Sequence
  Marburg virus siRNA sense strand
gacaaucaaaucacuuucagu

SEQ ID NO: 29751 - RNA, 21 nt, Artificial Sequence
  Marburg virus siRNA sense strand
acaaucaaaucacuuucaguu

SEQ ID NO: 29752 - RNA, 21 nt, Artificial Sequence
  Marburg virus siRNA sense strand
caaucaaaucacuuucaguuu

SEQ ID NO: 29753 - RNA, 21 nt, Artificial Sequence
  Marburg virus siRNA sense strand
aaucaaaucacuuucaguuuu

SEQ ID NO: 29754 - RNA, 21 nt, Artificial Sequence
  Marburg virus siRNA sense strand
aucaaaucacuuucaguuuuu

SEQ ID NO: 29755 - RNA, 21 nt, Artificial Sequence
  Marburg virus siRNA sense strand
ucaaaucacuuucaguuuuua

SEQ ID NO: 29756 - RNA, 21 nt, Artificial Sequence
  Marburg virus siRNA sense strand
caaaucacuuucaguuuuuag

SEQ ID NO: 29757 - RNA, 21 nt, Artificial Sequence
  Marburg virus siRNA sense strand
aaaucacuuucaguuuuuagu

SEQ ID NO: 29758 - RNA, 21 nt, Artificial Sequence
  Marburg virus siRNA sense strand
aaucacuuucaguuuuuaguu

SEQ ID NO: 29759 - RNA, 21 nt, Artificial Sequence
  Marburg virus siRNA sense strand
aucacuuucaguuuuuaguuu

SEQ ID NO: 29760 - RNA, 21 nt, Artificial Sequence
  Marburg virus siRNA sense strand
ucacuuucaguuuuuaguuuc

SEQ ID NO: 29761 - RNA, 21 nt, Artificial Sequence
  Marburg virus siRNA sense strand
cacuuucaguuuuuaguuuca

SEQ ID NO: 29762 - RNA, 21 nt, Artificial Sequence
  Marburg virus siRNA sense strand
acuuucaguuuuuaguuucaa

SEQ ID NO: 29763 - RNA, 21 nt, Artificial Sequence
  Marburg virus siRNA sense strand
cuuucaguuuuuaguuucaac

SEQ ID NO: 29764 - RNA, 21 nt, Artificial Sequence
  Marburg virus siRNA sense strand
uuucaguuuuuaguuucaacu

SEQ ID NO: 29765 - RNA, 21 nt, Artificial Sequence
  Marburg virus siRNA sense strand
uucaguuuuuaguuucaacuc

SEQ ID NO: 29766 - RNA, 21 nt, Artificial Sequence
  Marburg virus siRNA sense strand
ucaguuuuuaguuucaacucu

SEQ ID NO: 29767 - RNA, 21 nt, Artificial Sequence
  Marburg virus siRNA sense strand
caguuuuuaguuucaacucuu

SEQ ID NO: 29768 - RNA, 21 nt, Artificial Sequence
  Marburg virus siRNA sense strand
aguuuuuaguuucaacucuua

SEQ ID NO: 29769 - RNA, 21 nt, Artificial Sequence
  Marburg virus siRNA sense strand
guuuuuaguuucaacucuuau

SEQ ID NO: 29770 - RNA, 21 nt, Artificial Sequence
  Marburg virus siRNA sense strand
uuuuuaguuucaacucuuauu

SEQ ID NO: 29771 - RNA, 21 nt, Artificial Sequence
  Marburg virus siRNA sense strand
uuuuaguuucaacucuuauug

SEQ ID NO: 29772 - RNA, 21 nt, Artificial Sequence
  Marburg virus siRNA sense strand
uuuaguuucaacucuuauugc

SEQ ID NO: 29773 - RNA, 21 nt, Artificial Sequence
  Marburg virus siRNA sense strand
uuaguuucaacucuuauugcg

SEQ ID NO: 29774 - RNA, 21 nt, Artificial Sequence
  Marburg virus siRNA sense strand
uaguuucaacucuuauugcga

SEQ ID NO: 29775 - RNA, 21 nt, Artificial Sequence
  Marburg virus siRNA sense strand
aguuucaacucuuauugcgag

SEQ ID NO: 29776 - RNA, 21 nt, Artificial Sequence
  Marburg virus siRNA sense strand
guuucaacucuuauugcgaga

SEQ ID NO: 29777 - RNA, 21 nt, Artificial Sequence
  Marburg virus siRNA sense strand
uuucaacucuuauugcgagac

SEQ ID NO: 29778 - RNA, 21 nt, Artificial Sequence
  Marburg virus siRNA sense strand
uucaacucuuauugcgagacu

SEQ ID NO: 29779 - RNA, 21 nt, Artificial Sequence
  Marburg virus siRNA sense strand
ucaacucuuauugcgagacuu

SEQ ID NO: 29780 - RNA, 21 nt, Artificial Sequence
  Marburg virus siRNA sense strand
caacucuuauugcgagacuug

SEQ ID NO: 29781 - RNA, 21 nt, Artificial Sequence
  Marburg virus siRNA sense strand
aacucuuauugcgagacuuga

SEQ ID NO: 29782 - RNA, 21 nt, Artificial Sequence
  Marburg virus siRNA sense strand
acucuuauugcgagacuugaa

SEQ ID NO: 29783 - RNA, 21 nt, Artificial Sequence
  Marburg virus siRNA sense strand
cucuuauugcgagacuugaac

SEQ ID NO: 29784 - RNA, 21 nt, Artificial Sequence
  Marburg virus siRNA sense strand
ucuuauugcgagacuugaaca

SEQ ID NO: 29785 - RNA, 21 nt, Artificial Sequence
  Marburg virus siRNA sense strand
cuuauugcgagacuugaacac

SEQ ID NO: 29786 - RNA, 21 nt, Artificial Sequence
  Marburg virus siRNA sense strand
uuauugcgagacuugaacaca

SEQ ID NO: 29787 - RNA, 21 nt, Artificial Sequence
  Marburg virus siRNA sense strand
uauugcgagacuugaacacaa

SEQ ID NO: 29788 - RNA, 21 nt, Artificial Sequence
  Marburg virus siRNA sense strand
auugcgagacuugaacacaau

SEQ ID NO: 29789 - RNA, 21 nt, Artificial Sequence
  Marburg virus siRNA sense strand
uugcgagacuugaacacaauu

SEQ ID NO: 29790 - RNA, 21 nt, Artificial Sequence
  Marburg virus siRNA sense strand
ugcgagacuugaacacaauuc

SEQ ID NO: 29791 - RNA, 21 nt, Artificial Sequence
  Marburg virus siRNA sense strand
gcgagacuugaacacaauucu

SEQ ID NO: 29792 - RNA, 21 nt, Artificial Sequence
  Marburg virus siRNA sense strand
cgagacuugaacacaauucua

SEQ ID NO: 29793 - RNA, 21 nt, Artificial Sequence
  Marburg virus siRNA sense strand
gagacuugaacacaauucuac

SEQ ID NO: 29794 - RNA, 21 nt, Artificial Sequence
  Marburg virus siRNA sense strand
agacuugaacacaauucuacu

SEQ ID NO: 29795 - RNA, 21 nt, Artificial Sequence
  Marburg virus siRNA sense strand
gacuugaacacaauucuacua

SEQ ID NO: 29796 - RNA, 21 nt, Artificial Sequence
  Marburg virus siRNA sense strand
acuugaacacaauucuacuaa

SEQ ID NO: 29797 - RNA, 21 nt, Artificial Sequence
  Marburg virus siRNA sense strand
cuugaacacaauucuacuaac

SEQ ID NO: 29798 - RNA, 21 nt, Artificial Sequence
  Marburg virus siRNA sense strand
uugaacacaauucuacuaacu

SEQ ID NO: 29799 - RNA, 21 nt, Artificial Sequence
  Marburg virus siRNA sense strand
ugaacacaauucuacuaacuu

SEQ ID NO: 29800 - RNA, 21 nt, Artificial Sequence
  Marburg virus siRNA sense strand
gaacacaauucuacuaacuuc

SEQ ID NO: 29801 - RNA, 21 nt, Artificial Sequence
  Marburg virus siRNA sense strand
aacacaauucuacuaacuuca

SEQ ID NO: 29802 - RNA, 21 nt, Artificial Sequence
  Marburg virus siRNA sense strand
acacaauucuacuaacuucaa

SEQ ID NO: 29803 - RNA, 21 nt, Artificial Sequence
  Marburg virus siRNA sense strand
cacaauucuacuaacuucaau

SEQ ID NO: 29804 - RNA, 21 nt, Artificial Sequence
  Marburg virus siRNA sense strand
acaauucuacuaacuucaaua

SEQ ID NO: 29805 - RNA, 21 nt, Artificial Sequence
  Marburg virus siRNA sense strand
caauucuacuaacuucaauaa

SEQ ID NO: 29806 - RNA, 21 nt, Artificial Sequence
  Marburg virus siRNA sense strand
aauucuacuaacuucaauaag

SEQ ID NO: 29807 - RNA, 21 nt, Artificial Sequence
  Marburg virus siRNA sense strand
auucuacuaacuucaauaagu

SEQ ID NO: 29808 - RNA, 21 nt, Artificial Sequence
  Marburg virus siRNA sense strand
uucuacuaacuucaauaagug

SEQ ID NO: 29809 - RNA, 21 nt, Artificial Sequence
  Marburg virus siRNA sense strand
ucuacuaacuucaauaaguga

SEQ ID NO: 29810 - RNA, 21 nt, Artificial Sequence
  Marburg virus siRNA sense strand
cuacuaacuucaauaagugac

SEQ ID NO: 29811 - RNA, 21 nt, Artificial Sequence
  Marburg virus siRNA sense strand
uacuaacuucaauaagugacc

SEQ ID NO: 29812 - RNA, 21 nt, Artificial Sequence
  Marburg virus siRNA sense strand
acuaacuucaauaagugaccc

SEQ ID NO: 29813 - RNA, 21 nt, Artificial Sequence
  Marburg virus siRNA sense strand
cuaacuucaauaagugacccc

SEQ ID NO: 29814 - RNA, 21 nt, Artificial Sequence
  Marburg virus siRNA sense strand
uaacuucaauaagugacccca

SEQ ID NO: 29815 - RNA, 21 nt, Artificial Sequence
  Marburg virus siRNA sense strand
aacuucaauaagugaccccaa

SEQ ID NO: 29816 - RNA, 21 nt, Artificial Sequence
  Marburg virus siRNA sense strand
acuucaauaagugaccccaaa

SEQ ID NO: 29817 - RNA, 21 nt, Artificial Sequence
  Marburg virus siRNA sense strand
cuucaauaagugaccccaaau

SEQ ID NO: 29818 - RNA, 21 nt, Artificial Sequence
  Marburg virus siRNA sense strand
uucaauaagugaccccaaauu

SEQ ID NO: 29819 - RNA, 21 nt, Artificial Sequence
  Marburg virus siRNA sense strand
ucaauaagugaccccaaauuc

SEQ ID NO: 29820 - RNA, 21 nt, Artificial Sequence
  Marburg virus siRNA sense strand
caauaagugaccccaaauuca

SEQ ID NO: 29821 - RNA, 21 nt, Artificial Sequence
  Marburg virus siRNA sense strand
aauaagugaccccaaauucaa

SEQ ID NO: 29822 - RNA, 21 nt, Artificial Sequence
  Marburg virus siRNA sense strand
auaagugaccccaaauucaag

SEQ ID NO: 29823 - RNA, 21 nt, Artificial Sequence
  Marburg virus siRNA sense strand
uaagugaccccaaauucaagu

SEQ ID NO: 29824 - RNA, 21 nt, Artificial Sequence
  Marburg virus siRNA sense strand
aagugaccccaaauucaaguu

SEQ ID NO: 29825 - RNA, 21 nt, Artificial Sequence
  Marburg virus siRNA sense strand
agugaccccaaauucaaguuu

SEQ ID NO: 29826 - RNA, 21 nt, Artificial Sequence
  Marburg virus siRNA sense strand
gugaccccaaauucaaguuua

SEQ ID NO: 29827 - RNA, 21 nt, Artificial Sequence
  Marburg virus siRNA sense strand
ugaccccaaauucaaguuuac

SEQ ID NO: 29828 - RNA, 21 nt, Artificial Sequence
  Marburg virus siRNA sense strand
gaccccaaauucaaguuuacu

SEQ ID NO: 29829 - RNA, 21 nt, Artificial Sequence
  Marburg virus siRNA sense strand
accccaaauucaaguuuacug

SEQ ID NO: 29830 - RNA, 21 nt, Artificial Sequence
  Marburg virus siRNA sense strand
ccccaaauucaaguuuacuga

SEQ ID NO: 29831 - RNA, 21 nt, Artificial Sequence
  Marburg virus siRNA sense strand
cccaaauucaaguuuacugaa

SEQ ID NO: 29832 - RNA, 21 nt, Artificial Sequence
  Marburg virus siRNA sense strand
ccaaauucaaguuuacugaag

SEQ ID NO: 29833 - RNA, 21 nt, Artificial Sequence
  Marburg virus siRNA sense strand
caaauucaaguuuacugaaga

SEQ ID NO: 29834 - RNA, 21 nt, Artificial Sequence
  Marburg virus siRNA sense strand
aaauucaaguuuacugaagac

SEQ ID NO: 29835 - RNA, 21 nt, Artificial Sequence
  Marburg virus siRNA sense strand
aauucaaguuuacugaagacu

SEQ ID NO: 29836 - RNA, 21 nt, Artificial Sequence
  Marburg virus siRNA sense strand
auucaaguuuacugaagacua

SEQ ID NO: 29837 - RNA, 21 nt, Artificial Sequence
  Marburg virus siRNA sense strand
uucaaguuuacugaagacuac

SEQ ID NO: 29838 - RNA, 21 nt, Artificial Sequence
  Marburg virus siRNA sense strand
ucaaguuuacugaagacuacg

SEQ ID NO: 29839 - RNA, 21 nt, Artificial Sequence
  Marburg virus siRNA sense strand
caaguuuacugaagacuacga

SEQ ID NO: 29840 - RNA, 21 nt, Artificial Sequence
  Marburg virus siRNA sense strand
aaguuuacugaagacuacgac

SEQ ID NO: 29841 - RNA, 21 nt, Artificial Sequence
  Marburg virus siRNA sense strand
aguuuacugaagacuacgacg

SEQ ID NO: 29842 - RNA, 21 nt, Artificial Sequence
  Marburg virus siRNA sense strand
guuuacugaagacuacgacga

SEQ ID NO: 29843 - RNA, 21 nt, Artificial Sequence
  Marburg virus siRNA sense strand
uuuacugaagacuacgacgau

SEQ ID NO: 29844 - RNA, 21 nt, Artificial Sequence
  Marburg virus siRNA sense strand
uuacugaagacuacgacgaua

SEQ ID NO: 29845 - RNA, 21 nt, Artificial Sequence
  Marburg virus siRNA sense strand
uacugaagacuacgacgauaa

SEQ ID NO: 29846 - RNA, 21 nt, Artificial Sequence
  Marburg virus siRNA sense strand
acugaagacuacgacgauaau

SEQ ID NO: 29847 - RNA, 21 nt, Artificial Sequence
  Marburg virus siRNA sense strand
cugaagacuacgacgauaaua

SEQ ID NO: 29848 - RNA, 21 nt, Artificial Sequence
  Marburg virus siRNA sense strand
ugaagacuacgacgauaauaa

SEQ ID NO: 29849 - RNA, 21 nt, Artificial Sequence
  Marburg virus siRNA sense strand
gaagacuacgacgauaauaau

SEQ ID NO: 29850 - RNA, 21 nt, Artificial Sequence
  Marburg virus siRNA sense strand
aagacuacgacgauaauaauc

SEQ ID NO: 29851 - RNA, 21 nt, Artificial Sequence
  Marburg virus siRNA sense strand
agacuacgacgauaauaauca

SEQ ID NO: 29852 - RNA, 21 nt, Artificial Sequence
  Marburg virus siRNA sense strand
gacuacgacgauaauaaucac

SEQ ID NO: 29853 - RNA, 21 nt, Artificial Sequence
  Marburg virus siRNA sense strand
acuacgacgauaauaaucacc

SEQ ID NO: 29854 - RNA, 21 nt, Artificial Sequence
  Marburg virus siRNA sense strand
cuacgacgauaauaaucacca

SEQ ID NO: 29855 - RNA, 21 nt, Artificial Sequence
  Marburg virus siRNA sense strand
uacgacgauaauaaucaccaa

SEQ ID NO: 29856 - RNA, 21 nt, Artificial Sequence
  Marburg virus siRNA sense strand
acgacgauaauaaucaccaau

SEQ ID NO: 29857 - RNA, 21 nt, Artificial Sequence
  Marburg virus siRNA sense strand
cgacgauaauaaucaccaauu

SEQ ID NO: 29858 - RNA, 21 nt, Artificial Sequence
  Marburg virus siRNA sense strand
gacgauaauaaucaccaauuc

SEQ ID NO: 29859 - RNA, 21 nt, Artificial Sequence
  Marburg virus siRNA sense strand
acgauaauaaucaccaauuca

SEQ ID NO: 29860 - RNA, 21 nt, Artificial Sequence
  Marburg virus siRNA sense strand
cgauaauaaucaccaauucau

SEQ ID NO: 29861 - RNA, 21 nt, Artificial Sequence
  Marburg virus siRNA sense strand
gauaauaaucaccaauucauu

SEQ ID NO: 29862 - RNA, 21 nt, Artificial Sequence
  Marburg virus siRNA sense strand
auaauaaucaccaauucauug

SEQ ID NO: 29863 - RNA, 21 nt, Artificial Sequence
  Marburg virus siRNA sense strand
uaauaaucaccaauucauugu

SEQ ID NO: 29864 - RNA, 21 nt, Artificial Sequence
  Marburg virus siRNA sense strand
aauaaucaccaauucauugua

SEQ ID NO: 29865 - RNA, 21 nt, Artificial Sequence
  Marburg virus siRNA sense strand
auaaucaccaauucauuguaa

SEQ ID NO: 29866 - RNA, 21 nt, Artificial Sequence
  Marburg virus siRNA sense strand
uaaucaccaauucauuguaaa

SEQ ID NO: 29867 - RNA, 21 nt, Artificial Sequence
  Marburg virus siRNA sense strand
aaucaccaauucauuguaaau

SEQ ID NO: 29868 - RNA, 21 nt, Artificial Sequence
  Marburg virus siRNA sense strand
aucaccaauucauuguaaauu

SEQ ID NO: 29869 - RNA, 21 nt, Artificial Sequence
  Marburg virus siRNA sense strand
ucaccaauucauuguaaauua

SEQ ID NO: 29870 - RNA, 21 nt, Artificial Sequence
  Marburg virus siRNA sense strand
caccaauucauuguaaauuac

SEQ ID NO: 29871 - RNA, 21 nt, Artificial Sequence
  Marburg virus siRNA sense strand
accaauucauuguaaauuacu

SEQ ID NO: 29872 - RNA, 21 nt, Artificial Sequence
  Marburg virus siRNA sense strand
ccaauucauuguaaauuacuc

SEQ ID NO: 29873 - RNA, 21 nt, Artificial Sequence
  Marburg virus siRNA sense strand
caauucauuguaaauuacucg

SEQ ID NO: 29874 - RNA, 21 nt, Artificial Sequence
  Marburg virus siRNA sense strand
aauucauuguaaauuacucga

SEQ ID NO: 29875 - RNA, 21 nt, Artificial Sequence
  Marburg virus siRNA sense strand
auucauuguaaauuacucgau

SEQ ID NO: 29876 - RNA, 21 nt, Artificial Sequence
  Marburg virus siRNA sense strand
uucauuguaaauuacucgauu

SEQ ID NO: 29877 - RNA, 21 nt, Artificial Sequence
  Marburg virus siRNA sense strand
ucauuguaaauuacucgauua

SEQ ID NO: 29878 - RNA, 21 nt, Artificial Sequence
  Marburg virus siRNA sense strand
cauuguaaauuacucgauuaa

SEQ ID NO: 29879 - RNA, 21 nt, Artificial Sequence
  Marburg virus siRNA sense strand
auuguaaauuacucgauuaaa

SEQ ID NO: 29880 - RNA, 21 nt, Artificial Sequence
  Marburg virus siRNA sense strand
uuguaaauuacucgauuaaaa

SEQ ID NO: 29881 - RNA, 21 nt, Artificial Sequence
  Marburg virus siRNA sense strand
uguaaauuacucgauuaaaau

SEQ ID NO: 29882 - RNA, 21 nt, Artificial Sequence
  Marburg virus siRNA sense strand
guaaauuacucgauuaaaaua

SEQ ID NO: 29883 - RNA, 21 nt, Artificial Sequence
  Marburg virus siRNA sense strand
uaaauuacucgauuaaaauau

SEQ ID NO: 29884 - RNA, 21 nt, Artificial Sequence
  Marburg virus siRNA sense strand
aaauuacucgauuaaaauauu

SEQ ID NO: 29885 - RNA, 21 nt, Artificial Sequence
  Marburg virus siRNA sense strand
aauuacucgauuaaaauauuc

SEQ ID NO: 29886 - RNA, 21 nt, Artificial Sequence
  Marburg virus siRNA sense strand
auuacucgauuaaaauauucu

SEQ ID NO: 29887 - RNA, 21 nt, Artificial Sequence
  Marburg virus siRNA sense strand
uuacucgauuaaaauauucuu

SEQ ID NO: 29888 - RNA, 21 nt, Artificial Sequence
  Marburg virus siRNA sense strand
uacucgauuaaaauauucuua

SEQ ID NO: 29889 - RNA, 21 nt, Artificial Sequence
  Marburg virus siRNA sense strand
acucgauuaaaauauucuuaa

SEQ ID NO: 29890 - RNA, 21 nt, Artificial Sequence
  Marburg virus siRNA sense strand
cucgauuaaaauauucuuaag

SEQ ID NO: 29891 - RNA, 21 nt, Artificial Sequence
  Marburg virus siRNA sense strand
ucgauuaaaauauucuuaagc

SEQ ID NO: 29892 - RNA, 21 nt, Artificial Sequence
  Marburg virus siRNA sense strand
cgauuaaaauauucuuaagcu

SEQ ID NO: 29893 - RNA, 21 nt, Artificial Sequence
  Marburg virus siRNA sense strand
gauuaaaauauucuuaagcua

SEQ ID NO: 29894 - RNA, 21 nt, Artificial Sequence
  Marburg virus siRNA sense strand
auuaaaauauucuuaagcuau

SEQ ID NO: 29895 - RNA, 21 nt, Artificial Sequence
  Marburg virus siRNA sense strand
uuaaaauauucuuaagcuauc

SEQ ID NO: 29896 - RNA, 21 nt, Artificial Sequence
  Marburg virus siRNA sense strand
uaaaauauucuuaagcuaucu

SEQ ID NO: 29897 - RNA, 21 nt, Artificial Sequence
  Marburg virus siRNA sense strand
aaaauauucuuaagcuaucuu

SEQ ID NO: 29898 - RNA, 21 nt, Artificial Sequence
  Marburg virus siRNA sense strand
aaauauucuuaagcuaucuua

SEQ ID NO: 29899 - RNA, 21 nt, Artificial Sequence
  Marburg virus siRNA sense strand
aauauucuuaagcuaucuuaa

SEQ ID NO: 29900 - RNA, 21 nt, Artificial Sequence
  Marburg virus siRNA sense strand
auauucuuaagcuaucuuaaa

SEQ ID NO: 29901 - RNA, 21 nt, Artificial Sequence
  Marburg virus siRNA sense strand
uauucuuaagcuaucuuaaac

SEQ ID NO: 29902 - RNA, 21 nt, Artificial Sequence
  Marburg virus siRNA sense strand
auucuuaagcuaucuuaaacu

SEQ ID NO: 29903 - RNA, 21 nt, Artificial Sequence
  Marburg virus siRNA sense strand
uucuuaagcuaucuuaaacuu

SEQ ID NO: 29904 - RNA, 21 nt, Artificial Sequence
  Marburg virus siRNA sense strand
ucuuaagcuaucuuaaacuug

SEQ ID NO: 29905 - RNA, 21 nt, Artificial Sequence
  Marburg virus siRNA sense strand
cuuaagcuaucuuaaacuuga

SEQ ID NO: 29906 - RNA, 21 nt, Artificial Sequence
  Marburg virus siRNA sense strand
uuaagcuaucuuaaacuugau

SEQ ID NO: 29907 - RNA, 21 nt, Artificial Sequence
  Marburg virus siRNA sense strand
uaagcuaucuuaaacuugaug

SEQ ID NO: 29908 - RNA, 21 nt, Artificial Sequence
  Marburg virus siRNA sense strand
aagcuaucuuaaacuugauga

SEQ ID NO: 29909 - RNA, 21 nt, Artificial Sequence
  Marburg virus siRNA sense strand
agcuaucuuaaacuugaugau

SEQ ID NO: 29910 - RNA, 21 nt, Artificial Sequence
  Marburg virus siRNA sense strand
gcuaucuuaaacuugaugaug

SEQ ID NO: 29911 - RNA, 21 nt, Artificial Sequence
  Marburg virus siRNA sense strand
cuaucuuaaacuugaugaugc

SEQ ID NO: 29912 - RNA, 21 nt, Artificial Sequence
  Marburg virus siRNA sense strand
uaucuuaaacuugaugaugca

SEQ ID NO: 29913 - RNA, 21 nt, Artificial Sequence
  Marburg virus siRNA sense strand
aucuuaaacuugaugaugcag

SEQ ID NO: 29914 - RNA, 21 nt, Artificial Sequence
  Marburg virus siRNA sense strand
ucuuaaacuugaugaugcagc

SEQ ID NO: 29915 - RNA, 21 nt, Artificial Sequence
  Marburg virus siRNA sense strand
cuuaaacuugaugaugcagcu

SEQ ID NO: 29916 - RNA, 21 nt, Artificial Sequence
  Marburg virus siRNA sense strand
uuaaacuugaugaugcagcuc

SEQ ID NO: 29917 - RNA, 21 nt, Artificial Sequence
  Marburg virus siRNA sense strand
uaaacuugaugaugcagcucu

SEQ ID NO: 29918 - RNA, 21 nt, Artificial Sequence
  Marburg virus siRNA sense strand
aaacuugaugaugcagcucug

SEQ ID NO: 29919 - RNA, 21 nt, Artificial Sequence
  Marburg virus siRNA sense strand
aacuugaugaugcagcucugu

SEQ ID NO: 29920 - RNA, 21 nt, Artificial Sequence
  Marburg virus siRNA sense strand
acuugaugaugcagcucuguu

SEQ ID NO: 29921 - RNA, 21 nt, Artificial Sequence
  Marburg virus siRNA sense strand
cuugaugaugcagcucuguuu

SEQ ID NO: 29922 - RNA, 21 nt, Artificial Sequence
  Marburg virus siRNA sense strand
uugaugaugcagcucuguuuc

SEQ ID NO: 29923 - RNA, 21 nt, Artificial Sequence
  Marburg virus siRNA sense strand
ugaugaugcagcucuguuuca

SEQ ID NO: 29924 - RNA, 21 nt, Artificial Sequence
  Marburg virus siRNA sense strand
gaugaugcagcucuguuucac

SEQ ID NO: 29925 - RNA, 21 nt, Artificial Sequence
  Marburg virus siRNA sense strand
augaugcagcucuguuucacc

SEQ ID NO: 29926 - RNA, 21 nt, Artificial Sequence
  Marburg virus siRNA sense strand
ugaugcagcucuguuucaccu

SEQ ID NO: 29927 - RNA, 21 nt, Artificial Sequence
  Marburg virus siRNA sense strand
gaugcagcucuguuucaccuu

SEQ ID NO: 29928 - RNA, 21 nt, Artificial Sequence
  Marburg virus siRNA sense strand
augcagcucuguuucaccuuu

SEQ ID NO: 29929 - RNA, 21 nt, Artificial Sequence
  Marburg virus siRNA sense strand
ugcagcucuguuucaccuuuc

SEQ ID NO: 29930 - RNA, 21 nt, Artificial Sequence
  Marburg virus siRNA sense strand
gcagcucuguuucaccuuucu

SEQ ID NO: 29931 - RNA, 21 nt, Artificial Sequence
  Marburg virus siRNA sense strand
cagcucuguuucaccuuucug

SEQ ID NO: 29932 - RNA, 21 nt, Artificial Sequence
  Marburg virus siRNA sense strand
agcucuguuucaccuuucugu

SEQ ID NO: 29933 - RNA, 21 nt, Artificial Sequence
  Marburg virus siRNA sense strand
gcucuguuucaccuuucuguu

SEQ ID NO: 29934 - RNA, 21 nt, Artificial Sequence
  Marburg virus siRNA sense strand
cucuguuucaccuuucuguug

SEQ ID NO: 29935 - RNA, 21 nt, Artificial Sequence
  Marburg virus siRNA sense strand
ucuguuucaccuuucuguuga

SEQ ID NO: 29936 - RNA, 21 nt, Artificial Sequence
  Marburg virus siRNA sense strand
cuguuucaccuuucuguugau

SEQ ID NO: 29937 - RNA, 21 nt, Artificial Sequence
  Marburg virus siRNA sense strand
uguuucaccuuucuguugauu

SEQ ID NO: 29938 - RNA, 21 nt, Artificial Sequence
  Marburg virus siRNA sense strand
guuucaccuuucuguugauuu

SEQ ID NO: 29939 - RNA, 21 nt, Artificial Sequence
  Marburg virus siRNA sense strand
uuucaccuuucuguugauuuc

SEQ ID NO: 29940 - RNA, 21 nt, Artificial Sequence
  Marburg virus siRNA sense strand
uucaccuuucuguugauuuca

SEQ ID NO: 29941 - RNA, 21 nt, Artificial Sequence
  Marburg virus siRNA sense strand
ucaccuuucuguugauuucaa

SEQ ID NO: 29942 - RNA, 21 nt, Artificial Sequence
  Marburg virus siRNA sense strand
caccuuucuguugauuucaau

SEQ ID NO: 29943 - RNA, 21 nt, Artificial Sequence
  Marburg virus siRNA sense strand
accuuucuguugauuucaaug

SEQ ID NO: 29944 - RNA, 21 nt, Artificial Sequence
  Marburg virus siRNA sense strand
ccuuucuguugauuucaaugu

SEQ ID NO: 29945 - RNA, 21 nt, Artificial Sequence
  Marburg virus siRNA sense strand
cuuucuguugauuucaauguu

SEQ ID NO: 29946 - RNA, 21 nt, Artificial Sequence
  Marburg virus siRNA sense strand
uuucuguugauuucaauguua

SEQ ID NO: 29947 - RNA, 21 nt, Artificial Sequence
  Marburg virus siRNA sense strand
uucuguugauuucaauguuac

SEQ ID NO: 29948 - RNA, 21 nt, Artificial Sequence
  Marburg virus siRNA sense strand
ucuguugauuucaauguuaca

SEQ ID NO: 29949 - RNA, 21 nt, Artificial Sequence
  Marburg virus siRNA sense strand
cuguugauuucaauguuacag

SEQ ID NO: 29950 - RNA, 21 nt, Artificial Sequence
  Marburg virus siRNA sense strand
uguugauuucaauguuacagc

SEQ ID NO: 29951 - RNA, 21 nt, Artificial Sequence
  Marburg virus siRNA sense strand
guugauuucaauguuacagcu

SEQ ID NO: 29952 - RNA, 21 nt, Artificial Sequence
  Marburg virus siRNA sense strand
uugauuucaauguuacagcua

SEQ ID NO: 29953 - RNA, 21 nt, Artificial Sequence
  Marburg virus siRNA sense strand
ugauuucaauguuacagcuau

SEQ ID NO: 29954 - RNA, 21 nt, Artificial Sequence
  Marburg virus siRNA sense strand
gauuucaauguuacagcuaua

SEQ ID NO: 29955 - RNA, 21 nt, Artificial Sequence
  Marburg virus siRNA sense strand
auuucaauguuacagcuauau

SEQ ID NO: 29956 - RNA, 21 nt, Artificial Sequence
  Marburg virus siRNA sense strand
uuucaauguuacagcuauauc

SEQ ID NO: 29957 - RNA, 21 nt, Artificial Sequence
  Marburg virus siRNA sense strand
uucaauguuacagcuauaucu

SEQ ID NO: 29958 - RNA, 21 nt, Artificial Sequence
  Marburg virus siRNA sense strand
ucaauguuacagcuauaucua

SEQ ID NO: 29959 - RNA, 21 nt, Artificial Sequence
  Marburg virus siRNA sense strand
caauguuacagcuauaucuaa

SEQ ID NO: 29960 - RNA, 21 nt, Artificial Sequence
  Marburg virus siRNA sense strand
aauguuacagcuauaucuaag

SEQ ID NO: 29961 - RNA, 21 nt, Artificial Sequence
  Marburg virus siRNA sense strand
auguuacagcuauaucuaagu

SEQ ID NO: 29962 - RNA, 21 nt, Artificial Sequence
  Marburg virus siRNA sense strand
uguuacagcuauaucuaagug

SEQ ID NO: 29963 - RNA, 21 nt, Artificial Sequence
  Marburg virus siRNA sense strand
guuacagcuauaucuaagugu

SEQ ID NO: 29964 - RNA, 21 nt, Artificial Sequence
  Marburg virus siRNA sense strand
uuacagcuauaucuaaguguc

SEQ ID NO: 29965 - RNA, 21 nt, Artificial Sequence
  Marburg virus siRNA sense strand
uacagcuauaucuaagugucu

SEQ ID NO: 29966 - RNA, 21 nt, Artificial Sequence
  Marburg virus siRNA sense strand
acagcuauaucuaagugucua

SEQ ID NO: 29967 - RNA, 21 nt, Artificial Sequence
  Marburg virus siRNA sense strand
cagcuauaucuaagugucuaa

SEQ ID NO: 29968 - RNA, 21 nt, Artificial Sequence
  Marburg virus siRNA sense strand
agcuauaucuaagugucuaau

SEQ ID NO: 29969 - RNA, 21 nt, Artificial Sequence
  Marburg virus siRNA sense strand
gcuauaucuaagugucuaauu

SEQ ID NO: 29970 - RNA, 21 nt, Artificial Sequence
  Marburg virus siRNA sense strand
cuauaucuaagugucuaauua

SEQ ID NO: 29971 - RNA, 21 nt, Artificial Sequence
  Marburg virus siRNA sense strand
uauaucuaagugucuaauuaa

SEQ ID NO: 29972 - RNA, 21 nt, Artificial Sequence
  Marburg virus siRNA sense strand
auaucuaagugucuaauuaac

SEQ ID NO: 29973 - RNA, 21 nt, Artificial Sequence
  Marburg virus siRNA sense strand
uaucuaagugucuaauuaaca

SEQ ID NO: 29974 - RNA, 21 nt, Artificial Sequence
  Marburg virus siRNA sense strand
aucuaagugucuaauuaacaa

SEQ ID NO: 29975 - RNA, 21 nt, Artificial Sequence
  Marburg virus siRNA sense strand
ucuaagugucuaauuaacaac

SEQ ID NO: 29976 - RNA, 21 nt, Artificial Sequence
  Marburg virus siRNA sense strand
cuaagugucuaauuaacaacu

SEQ ID NO: 29977 - RNA, 21 nt, Artificial Sequence
  Marburg virus siRNA sense strand
uaagugucuaauuaacaacuu

SEQ ID NO: 29978 - RNA, 21 nt, Artificial Sequence
  Marburg virus siRNA sense strand
aagugucuaauuaacaacuug

SEQ ID NO: 29979 - RNA, 21 nt, Artificial Sequence
  Marburg virus siRNA sense strand
agugucuaauuaacaacuugu

SEQ ID NO: 29980 - RNA, 21 nt, Artificial Sequence
  Marburg virus siRNA sense strand
gugucuaauuaacaacuugua

SEQ ID NO: 29981 - RNA, 21 nt, Artificial Sequence
  Marburg virus siRNA sense strand
ugucuaauuaacaacuuguac

SEQ ID NO: 29982 - RNA, 21 nt, Artificial Sequence
  Marburg virus siRNA sense strand
gucuaauuaacaacuuguacc

SEQ ID NO: 29983 - RNA, 21 nt, Artificial Sequence
  Marburg virus siRNA sense strand
ucuaauuaacaacuuguaccu

SEQ ID NO: 29984 - RNA, 21 nt, Artificial Sequence
  Marburg virus siRNA sense strand
cuaauuaacaacuuguaccuc

SEQ ID NO: 29985 - RNA, 21 nt, Artificial Sequence
  Marburg virus siRNA sense strand
uaauuaacaacuuguaccucu

SEQ ID NO: 29986 - RNA, 21 nt, Artificial Sequence
  Marburg virus siRNA sense strand
aauuaacaacuuguaccucua

SEQ ID NO: 29987 - RNA, 21 nt, Artificial Sequence
  Marburg virus siRNA sense strand
auuaacaacuuguaccucuaa

SEQ ID NO: 29988 - RNA, 21 nt, Artificial Sequence
  Marburg virus siRNA sense strand
uuaacaacuuguaccucuaag

SEQ ID NO: 29989 - RNA, 21 nt, Artificial Sequence
  Marburg virus siRNA sense strand
uaacaacuuguaccucuaagg

SEQ ID NO: 29990 - RNA, 21 nt, Artificial Sequence
  Marburg virus siRNA sense strand
aacaacuuguaccucuaagga

SEQ ID NO: 29991 - RNA, 21 nt, Artificial Sequence
  Marburg virus siRNA sense strand
acaacuuguaccucuaaggaa

SEQ ID NO: 29992 - RNA, 21 nt, Artificial Sequence
  Marburg virus siRNA sense strand
caacuuguaccucuaaggaaa

SEQ ID NO: 29993 - RNA, 21 nt, Artificial Sequence
  Marburg virus siRNA sense strand
aacuuguaccucuaaggaaaa

SEQ ID NO: 29994 - RNA, 21 nt, Artificial Sequence
  Marburg virus siRNA sense strand
acuuguaccucuaaggaaaau

SEQ ID NO: 29995 - RNA, 21 nt, Artificial Sequence
  Marburg virus siRNA sense strand
cuuguaccucuaaggaaaauc

SEQ ID NO: 29996 - RNA, 21 nt, Artificial Sequence
  Marburg virus siRNA sense strand
uuguaccucuaaggaaaauca

SEQ ID NO: 29997 - RNA, 21 nt, Artificial Sequence
  Marburg virus siRNA sense strand
uguaccucuaaggaaaaucau

SEQ ID NO: 29998 - RNA, 21 nt, Artificial Sequence
  Marburg virus siRNA sense strand
guaccucuaaggaaaaucaug

SEQ ID NO: 29999 - RNA, 21 nt, Artificial Sequence
  Marburg virus siRNA sense strand
uaccucuaaggaaaaucauga

SEQ ID NO: 30000 - RNA, 21 nt, Artificial Sequence
  Marburg virus siRNA sense strand
accucuaaggaaaaucaugaa

SEQ ID NO: 30001 - RNA, 21 nt, Artificial Sequence
  Marburg virus siRNA sense strand
ccucuaaggaaaaucaugaag

SEQ ID NO: 30002 - RNA, 21 nt, Artificial Sequence
  Marburg virus siRNA sense strand
cucuaaggaaaaucaugaaga

SEQ ID NO: 30003 - RNA, 21 nt, Artificial Sequence
  Marburg virus siRNA sense strand
ucuaaggaaaaucaugaagaa

SEQ ID NO: 30004 - RNA, 21 nt, Artificial Sequence
  Marburg virus siRNA sense strand
cuaaggaaaaucaugaagaac

SEQ ID NO: 30005 - RNA, 21 nt, Artificial Sequence
  Marburg virus siRNA sense strand
uaaggaaaaucaugaagaaca

SEQ ID NO: 30006 - RNA, 21 nt, Artificial Sequence
  Marburg virus siRNA sense strand
aaggaaaaucaugaagaacau

SEQ ID NO: 30007 - RNA, 21 nt, Artificial Sequence
  Marburg virus siRNA sense strand
aggaaaaucaugaagaacauu

SEQ ID NO: 30008 - RNA, 21 nt, Artificial Sequence
  Marburg virus siRNA sense strand
ggaaaaucaugaagaacauua

SEQ ID NO: 30009 - RNA, 21 nt, Artificial Sequence
  Marburg virus siRNA sense strand
gaaaaucaugaagaacauuaa

SEQ ID NO: 30010 - RNA, 21 nt, Artificial Sequence
  Marburg virus siRNA sense strand
aaaaucaugaagaacauuaag

SEQ ID NO: 30011 - RNA, 21 nt, Artificial Sequence
  Marburg virus siRNA sense strand
aaaucaugaagaacauuaaga

SEQ ID NO: 30012 - RNA, 21 nt, Artificial Sequence
  Marburg virus siRNA sense strand
aaucaugaagaacauuaagaa

SEQ ID NO: 30013 - RNA, 21 nt, Artificial Sequence
  Marburg virus siRNA sense strand
aucaugaagaacauuaagaaa

SEQ ID NO: 30014 - RNA, 21 nt, Artificial Sequence
  Marburg virus siRNA sense strand
ucaugaagaacauuaagaaaa

SEQ ID NO: 30015 - RNA, 21 nt, Artificial Sequence
  Marburg virus siRNA sense strand
caugaagaacauuaagaaaaa

SEQ ID NO: 30016 - RNA, 21 nt, Artificial Sequence
  Marburg virus siRNA sense strand
augaagaacauuaagaaaaag

SEQ ID NO: 30017 - RNA, 21 nt, Artificial Sequence
  Marburg virus siRNA sense strand
ugaagaacauuaagaaaaagg

SEQ ID NO: 30018 - RNA, 21 nt, Artificial Sequence
  Marburg virus siRNA sense strand
gaagaacauuaagaaaaagga

SEQ ID NO: 30019 - RNA, 21 nt, Artificial Sequence
  Marburg virus siRNA sense strand
aagaacauuaagaaaaaggau

SEQ ID NO: 30020 - RNA, 21 nt, Artificial Sequence
  Marburg virus siRNA sense strand
agaacauuaagaaaaaggaug

SEQ ID NO: 30021 - RNA, 21 nt, Artificial Sequence
  Marburg virus siRNA sense strand
gaacauuaagaaaaaggaugu

SEQ ID NO: 30022 - RNA, 21 nt, Artificial Sequence
  Marburg virus siRNA sense strand
aacauuaagaaaaaggauguu

SEQ ID NO: 30023 - RNA, 21 nt, Artificial Sequence
  Marburg virus siRNA sense strand
acauuaagaaaaaggauguuc

SEQ ID NO: 30024 - RNA, 21 nt, Artificial Sequence
  Marburg virus siRNA sense strand
cauuaagaaaaaggauguucu

SEQ ID NO: 30025 - RNA, 21 nt, Artificial Sequence
  Marburg virus siRNA sense strand
auuaagaaaaaggauguucuu

SEQ ID NO: 30026 - RNA, 21 nt, Artificial Sequence
  Marburg virus siRNA sense strand
uuaagaaaaaggauguucuua

SEQ ID NO: 30027 - RNA, 21 nt, Artificial Sequence
  Marburg virus siRNA sense strand
uaagaaaaaggauguucuuau

SEQ ID NO: 30028 - RNA, 21 nt, Artificial Sequence
  Marburg virus siRNA sense strand
aagaaaaaggauguucuuauu

SEQ ID NO: 30029 - RNA, 21 nt, Artificial Sequence
  Marburg virus siRNA sense strand
agaaaaaggauguucuuauuu

SEQ ID NO: 30030 - RNA, 21 nt, Artificial Sequence
  Marburg virus siRNA sense strand
gaaaaaggauguucuuauuuu

SEQ ID NO: 30031 - RNA, 21 nt, Artificial Sequence
  Marburg virus siRNA sense strand
aaaaaggauguucuuauuuuu

SEQ ID NO: 30032 - RNA, 21 nt, Artificial Sequence
  Marburg virus siRNA sense strand
aaaaggauguucuuauuuuuc

SEQ ID NO: 30033 - RNA, 21 nt, Artificial Sequence
  Marburg virus siRNA sense strand
aaaggauguucuuauuuuuca

SEQ ID NO: 30034 - RNA, 21 nt, Artificial Sequence
  Marburg virus siRNA sense strand
aaggauguucuuauuuuucaa

SEQ ID NO: 30035 - RNA, 21 nt, Artificial Sequence
  Marburg virus siRNA sense strand
aggauguucuuauuuuucaac

SEQ ID NO: 30036 - RNA, 21 nt, Artificial Sequence
  Marburg virus siRNA sense strand
ggauguucuuauuuuucaacu

SEQ ID NO: 30037 - RNA, 21 nt, Artificial Sequence
  Marburg virus siRNA sense strand
gauguucuuauuuuucaacua

SEQ ID NO: 30038 - RNA, 21 nt, Artificial Sequence
  Marburg virus siRNA sense strand
auguucuuauuuuucaacuaa

SEQ ID NO: 30039 - RNA, 21 nt, Artificial Sequence
  Marburg virus siRNA sense strand
uguucuuauuuuucaacuaaa

SEQ ID NO: 30040 - RNA, 21 nt, Artificial Sequence
  Marburg virus siRNA sense strand
guucuuauuuuucaacuaaac

SEQ ID NO: 30041 - RNA, 21 nt, Artificial Sequence
  Marburg virus siRNA sense strand
uucuuauuuuucaacuaaacu

SEQ ID NO: 30042 - RNA, 21 nt, Artificial Sequence
  Marburg virus siRNA sense strand
ucuuauuuuucaacuaaacuu

SEQ ID NO: 30043 - RNA, 21 nt, Artificial Sequence
  Marburg virus siRNA sense strand
cuuauuuuucaacuaaacuug

SEQ ID NO: 30044 - RNA, 21 nt, Artificial Sequence
  Marburg virus siRNA sense strand
uuauuuuucaacuaaacuugc

SEQ ID NO: 30045 - RNA, 21 nt, Artificial Sequence
  Marburg virus siRNA sense strand
uauuuuucaacuaaacuugca

SEQ ID NO: 30046 - RNA, 21 nt, Artificial Sequence
  Marburg virus siRNA sense strand
auuuuucaacuaaacuugcau

SEQ ID NO: 30047 - RNA, 21 nt, Artificial Sequence
  Marburg virus siRNA sense strand
uuuuucaacuaaacuugcaua

SEQ ID NO: 30048 - RNA, 21 nt, Artificial Sequence
  Marburg virus siRNA sense strand
uuuucaacuaaacuugcauau

SEQ ID NO: 30049 - RNA, 21 nt, Artificial Sequence
  Marburg virus siRNA sense strand
uuucaacuaaacuugcauauc

SEQ ID NO: 30050 - RNA, 21 nt, Artificial Sequence
  Marburg virus siRNA sense strand
uucaacuaaacuugcauaucc

SEQ ID NO: 30051 - RNA, 21 nt, Artificial Sequence
  Marburg virus siRNA sense strand
ucaacuaaacuugcauauccu

SEQ ID NO: 30052 - RNA, 21 nt, Artificial Sequence
  Marburg virus siRNA sense strand
caacuaaacuugcauauccuu

SEQ ID NO: 30053 - RNA, 21 nt, Artificial Sequence
  Marburg virus siRNA sense strand
aacuaaacuugcauauccuuu

SEQ ID NO: 30054 - RNA, 21 nt, Artificial Sequence
  Marburg virus siRNA sense strand
acuaaacuugcauauccuuug

SEQ ID NO: 30055 - RNA, 21 nt, Artificial Sequence
  Marburg virus siRNA sense strand
cuaaacuugcauauccuuugu

SEQ ID NO: 30056 - RNA, 21 nt, Artificial Sequence
  Marburg virus siRNA sense strand
uaaacuugcauauccuuuguu

SEQ ID NO: 30057 - RNA, 21 nt, Artificial Sequence
  Marburg virus siRNA sense strand
aaacuugcauauccuuuguug

SEQ ID NO: 30058 - RNA, 21 nt, Artificial Sequence
  Marburg virus siRNA sense strand
aacuugcauauccuuuguuga

SEQ ID NO: 30059 - RNA, 21 nt, Artificial Sequence
  Marburg virus siRNA sense strand
acuugcauauccuuuguugau

SEQ ID NO: 30060 - RNA, 21 nt, Artificial Sequence
  Marburg virus siRNA sense strand
cuugcauauccuuuguugaua

SEQ ID NO: 30061 - RNA, 21 nt, Artificial Sequence
  Marburg virus siRNA sense strand
uugcauauccuuuguugauac

SEQ ID NO: 30062 - RNA, 21 nt, Artificial Sequence
  Marburg virus siRNA sense strand
ugcauauccuuuguugauacc

SEQ ID NO: 30063 - RNA, 21 nt, Artificial Sequence
  Marburg virus siRNA sense strand
gcauauccuuuguugauaccc

SEQ ID NO: 30064 - RNA, 21 nt, Artificial Sequence
  Marburg virus siRNA sense strand
cauauccuuuguugauacccu

SEQ ID NO: 30065 - RNA, 21 nt, Artificial Sequence
  Marburg virus siRNA sense strand
auauccuuuguugauacccuu

SEQ ID NO: 30066 - RNA, 21 nt, Artificial Sequence
  Marburg virus siRNA sense strand
uauccuuuguugauacccuug

SEQ ID NO: 30067 - RNA, 21 nt, Artificial Sequence
  Marburg virus siRNA sense strand
auccuuuguugauacccuuga

SEQ ID NO: 30068 - RNA, 21 nt, Artificial Sequence
  Marburg virus siRNA sense strand
uccuuuguugauacccuugag

SEQ ID NO: 30069 - RNA, 21 nt, Artificial Sequence
  Marburg virus siRNA sense strand
ccuuuguugauacccuugaga

SEQ ID NO: 30070 - RNA, 21 nt, Artificial Sequence
  Marburg virus siRNA sense strand
cuuuguugauacccuugagag

SEQ ID NO: 30071 - RNA, 21 nt, Artificial Sequence
  Marburg virus siRNA sense strand
uuuguugauacccuugagaga

SEQ ID NO: 30072 - RNA, 21 nt, Artificial Sequence
  Marburg virus siRNA sense strand
uuguugauacccuugagagac

SEQ ID NO: 30073 - RNA, 21 nt, Artificial Sequence
  Marburg virus siRNA sense strand
uguugauacccuugagagaca

SEQ ID NO: 30074 - RNA, 21 nt, Artificial Sequence
  Marburg virus siRNA sense strand
guugauacccuugagagacaa

SEQ ID NO: 30075 - RNA, 21 nt, Artificial Sequence
  Marburg virus siRNA sense strand
uugauacccuugagagacaac

SEQ ID NO: 30076 - RNA, 21 nt, Artificial Sequence
  Marburg virus siRNA sense strand
ugauacccuugagagacaacu

SEQ ID NO: 30077 - RNA, 21 nt, Artificial Sequence
  Marburg virus siRNA sense strand
gauacccuugagagacaacuu

SEQ ID NO: 30078 - RNA, 21 nt, Artificial Sequence
  Marburg virus siRNA sense strand
auacccuugagagacaacuuu

SEQ ID NO: 30079 - RNA, 21 nt, Artificial Sequence
  Marburg virus siRNA sense strand
uacccuugagagacaacuuuu

SEQ ID NO: 30080 - RNA, 21 nt, Artificial Sequence
  Marburg virus siRNA sense strand
acccuugagagacaacuuuug

SEQ ID NO: 30081 - RNA, 21 nt, Artificial Sequence
  Marburg virus siRNA sense strand
cccuugagagacaacuuuuga

SEQ ID NO: 30082 - RNA, 21 nt, Artificial Sequence
  Marburg virus siRNA sense strand
ccuugagagacaacuuuugac

SEQ ID NO: 30083 - RNA, 21 nt, Artificial Sequence
  Marburg virus siRNA sense strand
cuugagagacaacuuuugaca

SEQ ID NO: 30084 - RNA, 21 nt, Artificial Sequence
  Marburg virus siRNA sense strand
uugagagacaacuuuugacac

SEQ ID NO: 30085 - RNA, 21 nt, Artificial Sequence
  Marburg virus siRNA sense strand
ugagagacaacuuuugacacu

SEQ ID NO: 30086 - RNA, 21 nt, Artificial Sequence
  Marburg virus siRNA sense strand
gagagacaacuuuugacacua

SEQ ID NO: 30087 - RNA, 21 nt, Artificial Sequence
  Marburg virus siRNA sense strand
agagacaacuuuugacacuag

SEQ ID NO: 30088 - RNA, 21 nt, Artificial Sequence
  Marburg virus siRNA sense strand
gagacaacuuuugacacuaga

SEQ ID NO: 30089 - RNA, 21 nt, Artificial Sequence
  Marburg virus siRNA sense strand
agacaacuuuugacacuagau

SEQ ID NO: 30090 - RNA, 21 nt, Artificial Sequence
  Marburg virus siRNA sense strand
gacaacuuuugacacuagauc

SEQ ID NO: 30091 - RNA, 21 nt, Artificial Sequence
  Marburg virus siRNA sense strand
acaacuuuugacacuagauca

SEQ ID NO: 30092 - RNA, 21 nt, Artificial Sequence
  Marburg virus siRNA sense strand
caacuuuugacacuagaucac

SEQ ID NO: 30093 - RNA, 21 nt, Artificial Sequence
  Marburg virus siRNA sense strand
aacuuuugacacuagaucacg

SEQ ID NO: 30094 - RNA, 21 nt, Artificial Sequence
  Marburg virus siRNA sense strand
acuuuugacacuagaucacgg

SEQ ID NO: 30095 - RNA, 21 nt, Artificial Sequence
  Marburg virus siRNA sense strand
cuuuugacacuagaucacgga

SEQ ID NO: 30096 - RNA, 21 nt, Artificial Sequence
  Marburg virus siRNA sense strand
uuuugacacuagaucacggau

SEQ ID NO: 30097 - RNA, 21 nt, Artificial Sequence
  Marburg virus siRNA sense strand
uuugacacuagaucacggauc

SEQ ID NO: 30098 - RNA, 21 nt, Artificial Sequence
  Marburg virus siRNA sense strand
uugacacuagaucacggauca

SEQ ID NO: 30099 - RNA, 21 nt, Artificial Sequence
  Marburg virus siRNA sense strand
ugacacuagaucacggaucaa

SEQ ID NO: 30100 - RNA, 21 nt, Artificial Sequence
  Marburg virus siRNA sense strand
gacacuagaucacggaucaag

SEQ ID NO: 30101 - RNA, 21 nt, Artificial Sequence
  Marburg virus siRNA sense strand
acacuagaucacggaucaagc

SEQ ID NO: 30102 - RNA, 21 nt, Artificial Sequence
  Marburg virus siRNA sense strand
cacuagaucacggaucaagca

SEQ ID NO: 30103 - RNA, 21 nt, Artificial Sequence
  Marburg virus siRNA sense strand
acuagaucacggaucaagcau

SEQ ID NO: 30104 - RNA, 21 nt, Artificial Sequence
  Marburg virus siRNA sense strand
cuagaucacggaucaagcaua

SEQ ID NO: 30105 - RNA, 21 nt, Artificial Sequence
  Marburg virus siRNA sense strand
uagaucacggaucaagcauau

SEQ ID NO: 30106 - RNA, 21 nt, Artificial Sequence
  Marburg virus siRNA sense strand
agaucacggaucaagcauauu

SEQ ID NO: 30107 - RNA, 21 nt, Artificial Sequence
  Marburg virus siRNA sense strand
gaucacggaucaagcauauuu

SEQ ID NO: 30108 - RNA, 21 nt, Artificial Sequence
  Marburg virus siRNA sense strand
aucacggaucaagcauauuuc

SEQ ID NO: 30109 - RNA, 21 nt, Artificial Sequence
  Marburg virus siRNA sense strand
ucacggaucaagcauauuuca

SEQ ID NO: 30110 - RNA, 21 nt, Artificial Sequence
  Marburg virus siRNA sense strand
cacggaucaagcauauuucau

SEQ ID NO: 30111 - RNA, 21 nt, Artificial Sequence
  Marburg virus siRNA sense strand
acggaucaagcauauuucauu

SEQ ID NO: 30112 - RNA, 21 nt, Artificial Sequence
  Marburg virus siRNA sense strand
cggaucaagcauauuucauuc

SEQ ID NO: 30113 - RNA, 21 nt, Artificial Sequence
  Marburg virus siRNA sense strand
ggaucaagcauauuucauuca

SEQ ID NO: 30114 - RNA, 21 nt, Artificial Sequence
  Marburg virus siRNA sense strand
gaucaagcauauuucauucaa

SEQ ID NO: 30115 - RNA, 21 nt, Artificial Sequence
  Marburg virus siRNA sense strand
aucaagcauauuucauucaaa

SEQ ID NO: 30116 - RNA, 21 nt, Artificial Sequence
  Marburg virus siRNA sense strand
ucaagcauauuucauucaaac

SEQ ID NO: 30117 - RNA, 21 nt, Artificial Sequence
  Marburg virus siRNA sense strand
caagcauauuucauucaaaca

SEQ ID NO: 30118 - RNA, 21 nt, Artificial Sequence
  Marburg virus siRNA sense strand
aagcauauuucauucaaacac

SEQ ID NO: 30119 - RNA, 21 nt, Artificial Sequence
  Marburg virus siRNA sense strand
agcauauuucauucaaacacc

SEQ ID NO: 30120 - RNA, 21 nt, Artificial Sequence
  Marburg virus siRNA sense strand
gcauauuucauucaaacaccc

SEQ ID NO: 30121 - RNA, 21 nt, Artificial Sequence
  Marburg virus siRNA sense strand
cauauuucauucaaacacccc

SEQ ID NO: 30122 - RNA, 21 nt, Artificial Sequence
  Marburg virus siRNA sense strand
auauuucauucaaacacccca

SEQ ID NO: 30123 - RNA, 21 nt, Artificial Sequence
  Marburg virus siRNA sense strand
uauuucauucaaacaccccaa

SEQ ID NO: 30124 - RNA, 21 nt, Artificial Sequence
  Marburg virus siRNA sense strand
auuucauucaaacaccccaaa

SEQ ID NO: 30125 - RNA, 21 nt, Artificial Sequence
  Marburg virus siRNA sense strand
uuucauucaaacaccccaaau

SEQ ID NO: 30126 - RNA, 21 nt, Artificial Sequence
  Marburg virus siRNA sense strand
uucauucaaacaccccaaauu

SEQ ID NO: 30127 - RNA, 21 nt, Artificial Sequence
  Marburg virus siRNA sense strand
ucauucaaacaccccaaauuu

SEQ ID NO: 30128 - RNA, 21 nt, Artificial Sequence
  Marburg virus siRNA sense strand
cauucaaacaccccaaauuuu

SEQ ID NO: 30129 - RNA, 21 nt, Artificial Sequence
  Marburg virus siRNA sense strand
auucaaacaccccaaauuuuc

SEQ ID NO: 30130 - RNA, 21 nt, Artificial Sequence
  Marburg virus siRNA sense strand
uucaaacaccccaaauuuuca

SEQ ID NO: 30131 - RNA, 21 nt, Artificial Sequence
  Marburg virus siRNA sense strand
ucaaacaccccaaauuuucaa

SEQ ID NO: 30132 - RNA, 21 nt, Artificial Sequence
  Marburg virus siRNA sense strand
caaacaccccaaauuuucaau

SEQ ID NO: 30133 - RNA, 21 nt, Artificial Sequence
  Marburg virus siRNA sense strand
aaacaccccaaauuuucaauc

SEQ ID NO: 30134 - RNA, 21 nt, Artificial Sequence
  Marburg virus siRNA sense strand
aacaccccaaauuuucaauca

SEQ ID NO: 30135 - RNA, 21 nt, Artificial Sequence
  Marburg virus siRNA sense strand
acaccccaaauuuucaaucau

SEQ ID NO: 30136 - RNA, 21 nt, Artificial Sequence
  Marburg virus siRNA sense strand
caccccaaauuuucaaucaua

SEQ ID NO: 30137 - RNA, 21 nt, Artificial Sequence
  Marburg virus siRNA sense strand
accccaaauuuucaaucauac

SEQ ID NO: 30138 - RNA, 21 nt, Artificial Sequence
  Marburg virus siRNA sense strand
ccccaaauuuucaaucauaca

SEQ ID NO: 30139 - RNA, 21 nt, Artificial Sequence
  Marburg virus siRNA sense strand
cccaaauuuucaaucauacac

SEQ ID NO: 30140 - RNA, 21 nt, Artificial Sequence
  Marburg virus siRNA sense strand
ccaaauuuucaaucauacaca

SEQ ID NO: 30141 - RNA, 21 nt, Artificial Sequence
  Marburg virus siRNA sense strand
caaauuuucaaucauacacau

SEQ ID NO: 30142 - RNA, 21 nt, Artificial Sequence
  Marburg virus siRNA sense strand
aaauuuucaaucauacacaua

SEQ ID NO: 30143 - RNA, 21 nt, Artificial Sequence
  Marburg virus siRNA sense strand
aauuuucaaucauacacauaa

SEQ ID NO: 30144 - RNA, 21 nt, Artificial Sequence
  Marburg virus siRNA sense strand
auuuucaaucauacacauaau

SEQ ID NO: 30145 - RNA, 21 nt, Artificial Sequence
  Marburg virus siRNA sense strand
uuuucaaucauacacauaaua

SEQ ID NO: 30146 - RNA, 21 nt, Artificial Sequence
  Marburg virus siRNA sense strand
uuucaaucauacacauaauaa

SEQ ID NO: 30147 - RNA, 21 nt, Artificial Sequence
  Marburg virus siRNA sense strand
uucaaucauacacauaauaac

SEQ ID NO: 30148 - RNA, 21 nt, Artificial Sequence
  Marburg virus siRNA sense strand
ucaaucauacacauaauaacc

SEQ ID NO: 30149 - RNA, 21 nt, Artificial Sequence
  Marburg virus siRNA sense strand
caaucauacacauaauaacca

SEQ ID NO: 30150 - RNA, 21 nt, Artificial Sequence
  Marburg virus siRNA sense strand
aaucauacacauaauaaccau

SEQ ID NO: 30151 - RNA, 21 nt, Artificial Sequence
  Marburg virus siRNA sense strand
aucauacacauaauaaccauu

SEQ ID NO: 30152 - RNA, 21 nt, Artificial Sequence
  Marburg virus siRNA sense strand
ucauacacauaauaaccauuu

SEQ ID NO: 30153 - RNA, 21 nt, Artificial Sequence
  Marburg virus siRNA sense strand
cauacacauaauaaccauuuu

SEQ ID NO: 30154 - RNA, 21 nt, Artificial Sequence
  Marburg virus siRNA sense strand
auacacauaauaaccauuuua

SEQ ID NO: 30155 - RNA, 21 nt, Artificial Sequence
  Marburg virus siRNA sense strand
uacacauaauaaccauuuuag

SEQ ID NO: 30156 - RNA, 21 nt, Artificial Sequence
  Marburg virus siRNA sense strand
acacauaauaaccauuuuagu

SEQ ID NO: 30157 - RNA, 21 nt, Artificial Sequence
  Marburg virus siRNA sense strand
cacauaauaaccauuuuagua

SEQ ID NO: 30158 - RNA, 21 nt, Artificial Sequence
  Marburg virus siRNA sense strand
acauaauaaccauuuuaguag

SEQ ID NO: 30159 - RNA, 21 nt, Artificial Sequence
  Marburg virus siRNA sense strand
cauaauaaccauuuuaguagc

SEQ ID NO: 30160 - RNA, 21 nt, Artificial Sequence
  Marburg virus siRNA sense strand
auaauaaccauuuuaguagcg

SEQ ID NO: 30161 - RNA, 21 nt, Artificial Sequence
  Marburg virus siRNA sense strand
uaauaaccauuuuaguagcgu

SEQ ID NO: 30162 - RNA, 21 nt, Artificial Sequence
  Marburg virus siRNA sense strand
aauaaccauuuuaguagcguu

SEQ ID NO: 30163 - RNA, 21 nt, Artificial Sequence
  Marburg virus siRNA sense strand
auaaccauuuuaguagcguua

SEQ ID NO: 30164 - RNA, 21 nt, Artificial Sequence
  Marburg virus siRNA sense strand
uaaccauuuuaguagcguuac

SEQ ID NO: 30165 - RNA, 21 nt, Artificial Sequence
  Marburg virus siRNA sense strand
aaccauuuuaguagcguuacc

SEQ ID NO: 30166 - RNA, 21 nt, Artificial Sequence
  Marburg virus siRNA sense strand
accauuuuaguagcguuaccu

SEQ ID NO: 30167 - RNA, 21 nt, Artificial Sequence
  Marburg virus siRNA sense strand
ccauuuuaguagcguuaccuu

SEQ ID NO: 30168 - RNA, 21 nt, Artificial Sequence
  Marburg virus siRNA sense strand
cauuuuaguagcguuaccuuu

SEQ ID NO: 30169 - RNA, 21 nt, Artificial Sequence
  Marburg virus siRNA sense strand
auuuuaguagcguuaccuuuc

SEQ ID NO: 30170 - RNA, 21 nt, Artificial Sequence
  Marburg virus siRNA sense strand
uuuuaguagcguuaccuuuca

SEQ ID NO: 30171 - RNA, 21 nt, Artificial Sequence
  Marburg virus siRNA sense strand
uuuaguagcguuaccuuucaa

SEQ ID NO: 30172 - RNA, 21 nt, Artificial Sequence
  Marburg virus siRNA sense strand
uuaguagcguuaccuuucaau

SEQ ID NO: 30173 - RNA, 21 nt, Artificial Sequence
  Marburg virus siRNA sense strand
uaguagcguuaccuuucaaua

SEQ ID NO: 30174 - RNA, 21 nt, Artificial Sequence
  Marburg virus siRNA sense strand
aguagcguuaccuuucaauac

SEQ ID NO: 30175 - RNA, 21 nt, Artificial Sequence
  Marburg virus siRNA sense strand
guagcguuaccuuucaauaca

SEQ ID NO: 30176 - RNA, 21 nt, Artificial Sequence
  Marburg virus siRNA sense strand
uagcguuaccuuucaauacaa

SEQ ID NO: 30177 - RNA, 21 nt, Artificial Sequence
  Marburg virus siRNA sense strand
agcguuaccuuucaauacaau

SEQ ID NO: 30178 - RNA, 21 nt, Artificial Sequence
  Marburg virus siRNA sense strand
gcguuaccuuucaauacaauc

SEQ ID NO: 30179 - RNA, 21 nt, Artificial Sequence
  Marburg virus siRNA sense strand
cguuaccuuucaauacaaucu

SEQ ID NO: 30180 - RNA, 21 nt, Artificial Sequence
  Marburg virus siRNA sense strand
guuaccuuucaauacaaucua

SEQ ID NO: 30181 - RNA, 21 nt, Artificial Sequence
  Marburg virus siRNA sense strand
uuaccuuucaauacaaucuag

SEQ ID NO: 30182 - RNA, 21 nt, Artificial Sequence
  Marburg virus siRNA sense strand
uaccuuucaauacaaucuagg

SEQ ID NO: 30183 - RNA, 21 nt, Artificial Sequence
  Marburg virus siRNA sense strand
accuuucaauacaaucuaggu

SEQ ID NO: 30184 - RNA, 21 nt, Artificial Sequence
  Marburg virus siRNA sense strand
ccuuucaauacaaucuaggug

SEQ ID NO: 30185 - RNA, 21 nt, Artificial Sequence
  Marburg virus siRNA sense strand
cuuucaauacaaucuagguga

SEQ ID NO: 30186 - RNA, 21 nt, Artificial Sequence
  Marburg virus siRNA sense strand
uuucaauacaaucuaggugau

SEQ ID NO: 30187 - RNA, 21 nt, Artificial Sequence
  Marburg virus siRNA sense strand
uucaauacaaucuaggugauu

SEQ ID NO: 30188 - RNA, 21 nt, Artificial Sequence
  Marburg virus siRNA sense strand
ucaauacaaucuaggugauug

SEQ ID NO: 30189 - RNA, 21 nt, Artificial Sequence
  Marburg virus siRNA sense strand
caauacaaucuaggugauugu

SEQ ID NO: 30190 - RNA, 21 nt, Artificial Sequence
  Marburg virus siRNA sense strand
aauacaaucuaggugauugug

SEQ ID NO: 30191 - RNA, 21 nt, Artificial Sequence
  Marburg virus siRNA sense strand
auacaaucuaggugauuguga

SEQ ID NO: 30192 - RNA, 21 nt, Artificial Sequence
  Marburg virus siRNA sense strand
uacaaucuaggugauugugaa

SEQ ID NO: 30193 - RNA, 21 nt, Artificial Sequence
  Marburg virus siRNA sense strand
acaaucuaggugauugugaaa

SEQ ID NO: 30194 - RNA, 21 nt, Artificial Sequence
  Marburg virus siRNA sense strand
caaucuaggugauugugaaaa

SEQ ID NO: 30195 - RNA, 21 nt, Artificial Sequence
  Marburg virus siRNA sense strand
aaucuaggugauugugaaaag

SEQ ID NO: 30196 - RNA, 21 nt, Artificial Sequence
  Marburg virus siRNA sense strand
aucuaggugauugugaaaaga

SEQ ID NO: 30197 - RNA, 21 nt, Artificial Sequence
  Marburg virus siRNA sense strand
ucuaggugauugugaaaagac

SEQ ID NO: 30198 - RNA, 21 nt, Artificial Sequence
  Marburg virus siRNA sense strand
cuaggugauugugaaaagacu

SEQ ID NO: 30199 - RNA, 21 nt, Artificial Sequence
  Marburg virus siRNA sense strand
uaggugauugugaaaagacuu

SEQ ID NO: 30200 - RNA, 21 nt, Artificial Sequence
  Marburg virus siRNA sense strand
aggugauugugaaaagacuuc

SEQ ID NO: 30201 - RNA, 21 nt, Artificial Sequence
  Marburg virus siRNA sense strand
ggugauugugaaaagacuucc

SEQ ID NO: 30202 - RNA, 21 nt, Artificial Sequence
  Marburg virus siRNA sense strand
gugauugugaaaagacuucca

SEQ ID NO: 30203 - RNA, 21 nt, Artificial Sequence
  Marburg virus siRNA sense strand
ugauugugaaaagacuuccaa

SEQ ID NO: 30204 - RNA, 21 nt, Artificial Sequence
  Marburg virus siRNA sense strand
gauugugaaaagacuuccaaa

SEQ ID NO: 30205 - RNA, 21 nt, Artificial Sequence
  Marburg virus siRNA sense strand
auugugaaaagacuuccaaac

SEQ ID NO: 30206 - RNA, 21 nt, Artificial Sequence
  Marburg virus siRNA sense strand
uugugaaaagacuuccaaaca

SEQ ID NO: 30207 - RNA, 21 nt, Artificial Sequence
  Marburg virus siRNA sense strand
ugugaaaagacuuccaaacau

SEQ ID NO: 30208 - RNA, 21 nt, Artificial Sequence
  Marburg virus siRNA sense strand
gugaaaagacuuccaaacaug

SEQ ID NO: 30209 - RNA, 21 nt, Artificial Sequence
  Marburg virus siRNA sense strand
ugaaaagacuuccaaacaugg

SEQ ID NO: 30210 - RNA, 21 nt, Artificial Sequence
  Marburg virus siRNA sense strand
gaaaagacuuccaaacauggc

SEQ ID NO: 30211 - RNA, 21 nt, Artificial Sequence
  Marburg virus siRNA sense strand
aaaagacuuccaaacauggca

SEQ ID NO: 30212 - RNA, 21 nt, Artificial Sequence
  Marburg virus siRNA sense strand
aaagacuuccaaacauggcag

SEQ ID NO: 30213 - RNA, 21 nt, Artificial Sequence
  Marburg virus siRNA sense strand
aagacuuccaaacauggcaga

SEQ ID NO: 30214 - RNA, 21 nt, Artificial Sequence
  Marburg virus siRNA sense strand
agacuuccaaacauggcagaa

SEQ ID NO: 30215 - RNA, 21 nt, Artificial Sequence
  Marburg virus siRNA sense strand
gacuuccaaacauggcagaau

SEQ ID NO: 30216 - RNA, 21 nt, Artificial Sequence
  Marburg virus siRNA sense strand
acuuccaaacauggcagaauu

SEQ ID NO: 30217 - RNA, 21 nt, Artificial Sequence
  Marburg virus siRNA sense strand
cuuccaaacauggcagaauua

SEQ ID NO: 30218 - RNA, 21 nt, Artificial Sequence
  Marburg virus siRNA sense strand
uuccaaacauggcagaauuau

SEQ ID NO: 30219 - RNA, 21 nt, Artificial Sequence
  Marburg virus siRNA sense strand
uccaaacauggcagaauuauc

SEQ ID NO: 30220 - RNA, 21 nt, Artificial Sequence
  Marburg virus siRNA sense strand
ccaaacauggcagaauuauca

SEQ ID NO: 30221 - RNA, 21 nt, Artificial Sequence
  Marburg virus siRNA sense strand
caaacauggcagaauuaucaa

SEQ ID NO: 30222 - RNA, 21 nt, Artificial Sequence
  Marburg virus siRNA sense strand
aaacauggcagaauuaucaac

SEQ ID NO: 30223 - RNA, 21 nt, Artificial Sequence
  Marburg virus siRNA sense strand
aacauggcagaauuaucaacg

SEQ ID NO: 30224 - RNA, 21 nt, Artificial Sequence
  Marburg virus siRNA sense strand
acauggcagaauuaucaacgc

SEQ ID NO: 30225 - RNA, 21 nt, Artificial Sequence
  Marburg virus siRNA sense strand
cauggcagaauuaucaacgcg

SEQ ID NO: 30226 - RNA, 21 nt, Artificial Sequence
  Marburg virus siRNA sense strand
auggcagaauuaucaacgcgu

SEQ ID NO: 30227 - RNA, 21 nt, Artificial Sequence
  Marburg virus siRNA sense strand
uggcagaauuaucaacgcguu

SEQ ID NO: 30228 - RNA, 21 nt, Artificial Sequence
  Marburg virus siRNA sense strand
ggcagaauuaucaacgcguua

SEQ ID NO: 30229 - RNA, 21 nt, Artificial Sequence
  Marburg virus siRNA sense strand
gcagaauuaucaacgcguuac

SEQ ID NO: 30230 - RNA, 21 nt, Artificial Sequence
  Marburg virus siRNA sense strand
cagaauuaucaacgcguuaca

SEQ ID NO: 30231 - RNA, 21 nt, Artificial Sequence
  Marburg virus siRNA sense strand
agaauuaucaacgcguuacaa

SEQ ID NO: 30232 - RNA, 21 nt, Artificial Sequence
  Marburg virus siRNA sense strand
gaauuaucaacgcguuacaac

SEQ ID NO: 30233 - RNA, 21 nt, Artificial Sequence
  Marburg virus siRNA sense strand
aauuaucaacgcguuacaacu

SEQ ID NO: 30234 - RNA, 21 nt, Artificial Sequence
  Marburg virus siRNA sense strand
auuaucaacgcguuacaacuu

SEQ ID NO: 30235 - RNA, 21 nt, Artificial Sequence
  Marburg virus siRNA sense strand
uuaucaacgcguuacaacuug

SEQ ID NO: 30236 - RNA, 21 nt, Artificial Sequence
  Marburg virus siRNA sense strand
uaucaacgcguuacaacuugc

SEQ ID NO: 30237 - RNA, 21 nt, Artificial Sequence
  Marburg virus siRNA sense strand
aucaacgcguuacaacuugcc

SEQ ID NO: 30238 - RNA, 21 nt, Artificial Sequence
  Marburg virus siRNA sense strand
ucaacgcguuacaacuugccu

SEQ ID NO: 30239 - RNA, 21 nt, Artificial Sequence
  Marburg virus siRNA sense strand
caacgcguuacaacuugccug

SEQ ID NO: 30240 - RNA, 21 nt, Artificial Sequence
  Marburg virus siRNA sense strand
aacgcguuacaacuugccugc

SEQ ID NO: 30241 - RNA, 21 nt, Artificial Sequence
  Marburg virus siRNA sense strand
acgcguuacaacuugccugca

SEQ ID NO: 30242 - RNA, 21 nt, Artificial Sequence
  Marburg virus siRNA sense strand
cgcguuacaacuugccugcaa

SEQ ID NO: 30243 - RNA, 21 nt, Artificial Sequence
  Marburg virus siRNA sense strand
gcguuacaacuugccugcaaa

SEQ ID NO: 30244 - RNA, 21 nt, Artificial Sequence
  Marburg virus siRNA sense strand
cguuacaacuugccugcaaau

SEQ ID NO: 30245 - RNA, 21 nt, Artificial Sequence
  Marburg virus siRNA sense strand
guuacaacuugccugcaaaug

SEQ ID NO: 30246 - RNA, 21 nt, Artificial Sequence
  Marburg virus siRNA sense strand
uuacaacuugccugcaaaugu

SEQ ID NO: 30247 - RNA, 21 nt, Artificial Sequence
  Marburg virus siRNA sense strand
uacaacuugccugcaaauguu

SEQ ID NO: 30248 - RNA, 21 nt, Artificial Sequence
  Marburg virus siRNA sense strand
acaacuugccugcaaauguua

SEQ ID NO: 30249 - RNA, 21 nt, Artificial Sequence
  Marburg virus siRNA sense strand
caacuugccugcaaauguuac

SEQ ID NO: 30250 - RNA, 21 nt, Artificial Sequence
  Marburg virus siRNA sense strand
aacuugccugcaaauguuacg

SEQ ID NO: 30251 - RNA, 21 nt, Artificial Sequence
  Marburg virus siRNA sense strand
acuugccugcaaauguuacgg

SEQ ID NO: 30252 - RNA, 21 nt, Artificial Sequence
  Marburg virus siRNA sense strand
cuugccugcaaauguuacgga

SEQ ID NO: 30253 - RNA, 21 nt, Artificial Sequence
  Marburg virus siRNA sense strand
uugccugcaaauguuacggaa

SEQ ID NO: 30254 - RNA, 21 nt, Artificial Sequence
  Marburg virus siRNA sense strand
ugccugcaaauguuacggaaa

SEQ ID NO: 30255 - RNA, 21 nt, Artificial Sequence
  Marburg virus siRNA sense strand
gccugcaaauguuacggaaaa

SEQ ID NO: 30256 - RNA, 21 nt, Artificial Sequence
  Marburg virus siRNA sense strand
ccugcaaauguuacggaaaaa

SEQ ID NO: 30257 - RNA, 21 nt, Artificial Sequence
  Marburg virus siRNA sense strand
cugcaaauguuacggaaaaaa

SEQ ID NO: 30258 - RNA, 21 nt, Artificial Sequence
  Marburg virus siRNA sense strand
ugcaaauguuacggaaaaaag

SEQ ID NO: 30259 - RNA, 21 nt, Artificial Sequence
  Marburg virus siRNA sense strand
gcaaauguuacggaaaaaagc

SEQ ID NO: 30260 - RNA, 21 nt, Artificial Sequence
  Marburg virus siRNA sense strand
caaauguuacggaaaaaagca

SEQ ID NO: 30261 - RNA, 21 nt, Artificial Sequence
  Marburg virus siRNA sense strand
aaauguuacggaaaaaagcau

SEQ ID NO: 30262 - RNA, 21 nt, Artificial Sequence
  Marburg virus siRNA sense strand
aauguuacggaaaaaagcaua

SEQ ID NO: 30263 - RNA, 21 nt, Artificial Sequence
  Marburg virus siRNA sense strand
auguuacggaaaaaagcauaa

SEQ ID NO: 30264 - RNA, 21 nt, Artificial Sequence
  Marburg virus siRNA sense strand
uguuacggaaaaaagcauaaa

SEQ ID NO: 30265 - RNA, 21 nt, Artificial Sequence
  Marburg virus siRNA sense strand
guuacggaaaaaagcauaaau

SEQ ID NO: 30266 - RNA, 21 nt, Artificial Sequence
  Marburg virus siRNA sense strand
uuacggaaaaaagcauaaauc

SEQ ID NO: 30267 - RNA, 21 nt, Artificial Sequence
  Marburg virus siRNA sense strand
uacggaaaaaagcauaaaucu

SEQ ID NO: 30268 - RNA, 21 nt, Artificial Sequence
  Marburg virus siRNA sense strand
acggaaaaaagcauaaaucuu

SEQ ID NO: 30269 - RNA, 21 nt, Artificial Sequence
  Marburg virus siRNA sense strand
cggaaaaaagcauaaaucuug

SEQ ID NO: 30270 - RNA, 21 nt, Artificial Sequence
  Marburg virus siRNA sense strand
ggaaaaaagcauaaaucuuga

SEQ ID NO: 30271 - RNA, 21 nt, Artificial Sequence
  Marburg virus siRNA sense strand
gaaaaaagcauaaaucuugac

SEQ ID NO: 30272 - RNA, 21 nt, Artificial Sequence
  Marburg virus siRNA sense strand
aaaaaagcauaaaucuugacc

SEQ ID NO: 30273 - RNA, 21 nt, Artificial Sequence
  Marburg virus siRNA sense strand
aaaaagcauaaaucuugaccu

SEQ ID NO: 30274 - RNA, 21 nt, Artificial Sequence
  Marburg virus siRNA sense strand
aaaagcauaaaucuugaccuu

SEQ ID NO: 30275 - RNA, 21 nt, Artificial Sequence
  Marburg virus siRNA sense strand
aaagcauaaaucuugaccuua

SEQ ID NO: 30276 - RNA, 21 nt, Artificial Sequence
  Marburg virus siRNA sense strand
aagcauaaaucuugaccuuaa

SEQ ID NO: 30277 - RNA, 21 nt, Artificial Sequence
  Marburg virus siRNA sense strand
agcauaaaucuugaccuuaau

SEQ ID NO: 30278 - RNA, 21 nt, Artificial Sequence
  Marburg virus siRNA sense strand
gcauaaaucuugaccuuaauu

SEQ ID NO: 30279 - RNA, 21 nt, Artificial Sequence
  Marburg virus siRNA sense strand
cauaaaucuugaccuuaauuc

SEQ ID NO: 30280 - RNA, 21 nt, Artificial Sequence
  Marburg virus siRNA sense strand
auaaaucuugaccuuaauucc

SEQ ID NO: 30281 - RNA, 21 nt, Artificial Sequence
  Marburg virus siRNA sense strand
uaaaucuugaccuuaauucca

SEQ ID NO: 30282 - RNA, 21 nt, Artificial Sequence
  Marburg virus siRNA sense strand
aaaucuugaccuuaauuccac

SEQ ID NO: 30283 - RNA, 21 nt, Artificial Sequence
  Marburg virus siRNA sense strand
aaucuugaccuuaauuccaca

SEQ ID NO: 30284 - RNA, 21 nt, Artificial Sequence
  Marburg virus siRNA sense strand
aucuugaccuuaauuccacag

SEQ ID NO: 30285 - RNA, 21 nt, Artificial Sequence
  Marburg virus siRNA sense strand
ucuugaccuuaauuccacagc

SEQ ID NO: 30286 - RNA, 21 nt, Artificial Sequence
  Marburg virus siRNA sense strand
cuugaccuuaauuccacagca

SEQ ID NO: 30287 - RNA, 21 nt, Artificial Sequence
  Marburg virus siRNA sense strand
uugaccuuaauuccacagcac

SEQ ID NO: 30288 - RNA, 21 nt, Artificial Sequence
  Marburg virus siRNA sense strand
ugaccuuaauuccacagcacg

SEQ ID NO: 30289 - RNA, 21 nt, Artificial Sequence
  Marburg virus siRNA sense strand
gaccuuaauuccacagcacga

SEQ ID NO: 30290 - RNA, 21 nt, Artificial Sequence
  Marburg virus siRNA sense strand
accuuaauuccacagcacgau

SEQ ID NO: 30291 - RNA, 21 nt, Artificial Sequence
  Marburg virus siRNA sense strand
ccuuaauuccacagcacgaug

SEQ ID NO: 30292 - RNA, 21 nt, Artificial Sequence
  Marburg virus siRNA sense strand
cuuaauuccacagcacgaugg

SEQ ID NO: 30293 - RNA, 21 nt, Artificial Sequence
  Marburg virus siRNA sense strand
uuaauuccacagcacgaugga

SEQ ID NO: 30294 - RNA, 21 nt, Artificial Sequence
  Marburg virus siRNA sense strand
uaauuccacagcacgauggau

SEQ ID NO: 30295 - RNA, 21 nt, Artificial Sequence
  Marburg virus siRNA sense strand
aauuccacagcacgauggaua

SEQ ID NO: 30296 - RNA, 21 nt, Artificial Sequence
  Marburg virus siRNA sense strand
auuccacagcacgauggauaa

SEQ ID NO: 30297 - RNA, 21 nt, Artificial Sequence
  Marburg virus siRNA sense strand
uuccacagcacgauggauaaa

SEQ ID NO: 30298 - RNA, 21 nt, Artificial Sequence
  Marburg virus siRNA sense strand
uccacagcacgauggauaaaa

SEQ ID NO: 30299 - RNA, 21 nt, Artificial Sequence
  Marburg virus siRNA sense strand
ccacagcacgauggauaaaag

SEQ ID NO: 30300 - RNA, 21 nt, Artificial Sequence
  Marburg virus siRNA sense strand
cacagcacgauggauaaaaga

SEQ ID NO: 30301 - RNA, 21 nt, Artificial Sequence
  Marburg virus siRNA sense strand
acagcacgauggauaaaagaa

SEQ ID NO: 30302 - RNA, 21 nt, Artificial Sequence
  Marburg virus siRNA sense strand
cagcacgauggauaaaagaac

SEQ ID NO: 30303 - RNA, 21 nt, Artificial Sequence
  Marburg virus siRNA sense strand
agcacgauggauaaaagaacc

SEQ ID NO: 30304 - RNA, 21 nt, Artificial Sequence
  Marburg virus siRNA sense strand
gcacgauggauaaaagaaccc

SEQ ID NO: 30305 - RNA, 21 nt, Artificial Sequence
  Marburg virus siRNA sense strand
cacgauggauaaaagaaccca

SEQ ID NO: 30306 - RNA, 21 nt, Artificial Sequence
  Marburg virus siRNA sense strand
acgauggauaaaagaacccag

SEQ ID NO: 30307 - RNA, 21 nt, Artificial Sequence
  Marburg virus siRNA sense strand
cgauggauaaaagaacccagu

SEQ ID NO: 30308 - RNA, 21 nt, Artificial Sequence
  Marburg virus siRNA sense strand
gauggauaaaagaacccagug

SEQ ID NO: 30309 - RNA, 21 nt, Artificial Sequence
  Marburg virus siRNA sense strand
auggauaaaagaacccagugu

SEQ ID NO: 30310 - RNA, 21 nt, Artificial Sequence
  Marburg virus siRNA sense strand
uggauaaaagaacccaguguu

SEQ ID NO: 30311 - RNA, 21 nt, Artificial Sequence
  Marburg virus siRNA sense strand
ggauaaaagaacccaguguug

SEQ ID NO: 30312 - RNA, 21 nt, Artificial Sequence
  Marburg virus siRNA sense strand
gauaaaagaacccaguguugg

SEQ ID NO: 30313 - RNA, 21 nt, Artificial Sequence
  Marburg virus siRNA sense strand
auaaaagaacccaguguuggg

SEQ ID NO: 30314 - RNA, 21 nt, Artificial Sequence
  Marburg virus siRNA sense strand
uaaaagaacccaguguugggg

SEQ ID NO: 30315 - RNA, 21 nt, Artificial Sequence
  Marburg virus siRNA sense strand
aaaagaacccaguguuggggg

SEQ ID NO: 30316 - RNA, 21 nt, Artificial Sequence
  Marburg virus siRNA sense strand
aaagaacccaguguugggggc

SEQ ID NO: 30317 - RNA, 21 nt, Artificial Sequence
  Marburg virus siRNA sense strand
aagaacccaguguugggggcu

SEQ ID NO: 30318 - RNA, 21 nt, Artificial Sequence
  Marburg virus siRNA sense strand
agaacccaguguugggggcug

SEQ ID NO: 30319 - RNA, 21 nt, Artificial Sequence
  Marburg virus siRNA sense strand
gaacccaguguugggggcugg

SEQ ID NO: 30320 - RNA, 21 nt, Artificial Sequence
  Marburg virus siRNA sense strand
aacccaguguugggggcugga

SEQ ID NO: 30321 - RNA, 21 nt, Artificial Sequence
  Marburg virus siRNA sense strand
acccaguguugggggcuggac

SEQ ID NO: 30322 - RNA, 21 nt, Artificial Sequence
  Marburg virus siRNA sense strand
cccaguguugggggcuggaca

SEQ ID NO: 30323 - RNA, 21 nt, Artificial Sequence
  Marburg virus siRNA sense strand
ccaguguugggggcuggacag

SEQ ID NO: 30324 - RNA, 21 nt, Artificial Sequence
  Marburg virus siRNA sense strand
caguguugggggcuggacagu

SEQ ID NO: 30325 - RNA, 21 nt, Artificial Sequence
  Marburg virus siRNA sense strand
aguguugggggcuggacagug

SEQ ID NO: 30326 - RNA, 21 nt, Artificial Sequence
  Marburg virus siRNA sense strand
guguugggggcuggacaguga

SEQ ID NO: 30327 - RNA, 21 nt, Artificial Sequence
  Marburg virus siRNA sense strand
uguugggggcuggacagugaa

SEQ ID NO: 30328 - RNA, 21 nt, Artificial Sequence
  Marburg virus siRNA sense strand
guugggggcuggacagugaag

SEQ ID NO: 30329 - RNA, 21 nt, Artificial Sequence
  Marburg virus siRNA sense strand
uugggggcuggacagugaagu

SEQ ID NO: 30330 - RNA, 21 nt, Artificial Sequence
  Marburg virus siRNA sense strand
ugggggcuggacagugaagug

SEQ ID NO: 30331 - RNA, 21 nt, Artificial Sequence
  Marburg virus siRNA sense strand
gggggcuggacagugaagugg

SEQ ID NO: 30332 - RNA, 21 nt, Artificial Sequence
  Marburg virus siRNA sense strand
ggggcuggacagugaaguggg

SEQ ID NO: 30333 - RNA, 21 nt, Artificial Sequence
  Marburg virus siRNA sense strand
gggcuggacagugaagugggg

SEQ ID NO: 30334 - RNA, 21 nt, Artificial Sequence
  Marburg virus siRNA sense strand
ggcuggacagugaagugggga

SEQ ID NO: 30335 - RNA, 21 nt, Artificial Sequence
  Marburg virus siRNA sense strand
gcuggacagugaaguggggaa

SEQ ID NO: 30336 - RNA, 21 nt, Artificial Sequence
  Marburg virus siRNA sense strand
cuggacagugaaguggggaaa

SEQ ID NO: 30337 - RNA, 21 nt, Artificial Sequence
  Marburg virus siRNA sense strand
uggacagugaaguggggaaac

SEQ ID NO: 30338 - RNA, 21 nt, Artificial Sequence
  Marburg virus siRNA sense strand
ggacagugaaguggggaaacu

SEQ ID NO: 30339 - RNA, 21 nt, Artificial Sequence
  Marburg virus siRNA sense strand
gacagugaaguggggaaacuu

SEQ ID NO: 30340 - RNA, 21 nt, Artificial Sequence
  Marburg virus siRNA sense strand
acagugaaguggggaaacuuu

SEQ ID NO: 30341 - RNA, 21 nt, Artificial Sequence
  Marburg virus siRNA sense strand
cagugaaguggggaaacuuug

SEQ ID NO: 30342 - RNA, 21 nt, Artificial Sequence
  Marburg virus siRNA sense strand
agugaaguggggaaacuuugu

SEQ ID NO: 30343 - RNA, 21 nt, Artificial Sequence
  Marburg virus siRNA sense strand
gugaaguggggaaacuuuguu

SEQ ID NO: 30344 - RNA, 21 nt, Artificial Sequence
  Marburg virus siRNA sense strand
ugaaguggggaaacuuuguuu

SEQ ID NO: 30345 - RNA, 21 nt, Artificial Sequence
  Marburg virus siRNA sense strand
gaaguggggaaacuuuguuuu

SEQ ID NO: 30346 - RNA, 21 nt, Artificial Sequence
  Marburg virus siRNA sense strand
aaguggggaaacuuuguuuuc

SEQ ID NO: 30347 - RNA, 21 nt, Artificial Sequence
  Marburg virus siRNA sense strand
aguggggaaacuuuguuuucc

SEQ ID NO: 30348 - RNA, 21 nt, Artificial Sequence
  Marburg virus siRNA sense strand
guggggaaacuuuguuuucca

SEQ ID NO: 30349 - RNA, 21 nt, Artificial Sequence
  Marburg virus siRNA sense strand
uggggaaacuuuguuuuccac

SEQ ID NO: 30350 - RNA, 21 nt, Artificial Sequence
  Marburg virus siRNA sense strand
ggggaaacuuuguuuuccaca

SEQ ID NO: 30351 - RNA, 21 nt, Artificial Sequence
  Marburg virus siRNA sense strand
gggaaacuuuguuuuccacau

SEQ ID NO: 30352 - RNA, 21 nt, Artificial Sequence
  Marburg virus siRNA sense strand
ggaaacuuuguuuuccacaua

SEQ ID NO: 30353 - RNA, 21 nt, Artificial Sequence
  Marburg virus siRNA sense strand
gaaacuuuguuuuccacauac

SEQ ID NO: 30354 - RNA, 21 nt, Artificial Sequence
  Marburg virus siRNA sense strand
aaacuuuguuuuccacauacc

SEQ ID NO: 30355 - RNA, 21 nt, Artificial Sequence
  Marburg virus siRNA sense strand
aacuuuguuuuccacauacca

SEQ ID NO: 30356 - RNA, 21 nt, Artificial Sequence
  Marburg virus siRNA sense strand
acuuuguuuuccacauaccaa

SEQ ID NO: 30357 - RNA, 21 nt, Artificial Sequence
  Marburg virus siRNA sense strand
cuuuguuuuccacauaccaaa

SEQ ID NO: 30358 - RNA, 21 nt, Artificial Sequence
  Marburg virus siRNA sense strand
uuuguuuuccacauaccaaau

SEQ ID NO: 30359 - RNA, 21 nt, Artificial Sequence
  Marburg virus siRNA sense strand
uuguuuuccacauaccaaaua

SEQ ID NO: 30360 - RNA, 21 nt, Artificial Sequence
  Marburg virus siRNA sense strand
uguuuuccacauaccaaauac

SEQ ID NO: 30361 - RNA, 21 nt, Artificial Sequence
  Marburg virus siRNA sense strand
guuuuccacauaccaaauacu

SEQ ID NO: 30362 - RNA, 21 nt, Artificial Sequence
  Marburg virus siRNA sense strand
uuuuccacauaccaaauacug

SEQ ID NO: 30363 - RNA, 21 nt, Artificial Sequence
  Marburg virus siRNA sense strand
uuuccacauaccaaauacugg

SEQ ID NO: 30364 - RNA, 21 nt, Artificial Sequence
  Marburg virus siRNA sense strand
uuccacauaccaaauacuggg

SEQ ID NO: 30365 - RNA, 21 nt, Artificial Sequence
  Marburg virus siRNA sense strand
uccacauaccaaauacuggga

SEQ ID NO: 30366 - RNA, 21 nt, Artificial Sequence
  Marburg virus siRNA sense strand
ccacauaccaaauacugggau

SEQ ID NO: 30367 - RNA, 21 nt, Artificial Sequence
  Marburg virus siRNA sense strand
cacauaccaaauacugggaug

SEQ ID NO: 30368 - RNA, 21 nt, Artificial Sequence
  Marburg virus siRNA sense strand
acauaccaaauacugggaugg

SEQ ID NO: 30369 - RNA, 21 nt, Artificial Sequence
  Marburg virus siRNA sense strand
cauaccaaauacugggauggc

SEQ ID NO: 30370 - RNA, 21 nt, Artificial Sequence
  Marburg virus siRNA sense strand
auaccaaauacugggauggca

SEQ ID NO: 30371 - RNA, 21 nt, Artificial Sequence
  Marburg virus siRNA sense strand
uaccaaauacugggauggcau

SEQ ID NO: 30372 - RNA, 21 nt, Artificial Sequence
  Marburg virus siRNA sense strand
accaaauacugggauggcauu

SEQ ID NO: 30373 - RNA, 21 nt, Artificial Sequence
  Marburg virus siRNA sense strand
ccaaauacugggauggcauug

SEQ ID NO: 30374 - RNA, 21 nt, Artificial Sequence
  Marburg virus siRNA sense strand
caaauacugggauggcauugu

SEQ ID NO: 30375 - RNA, 21 nt, Artificial Sequence
  Marburg virus siRNA sense strand
aaauacugggauggcauuguu

SEQ ID NO: 30376 - RNA, 21 nt, Artificial Sequence
  Marburg virus siRNA sense strand
aauacugggauggcauuguug

SEQ ID NO: 30377 - RNA, 21 nt, Artificial Sequence
  Marburg virus siRNA sense strand
auacugggauggcauuguugc

SEQ ID NO: 30378 - RNA, 21 nt, Artificial Sequence
  Marburg virus siRNA sense strand
uacugggauggcauuguugca

SEQ ID NO: 30379 - RNA, 21 nt, Artificial Sequence
  Marburg virus siRNA sense strand
acugggauggcauuguugcau

SEQ ID NO: 30380 - RNA, 21 nt, Artificial Sequence
  Marburg virus siRNA sense strand
cugggauggcauuguugcauc

SEQ ID NO: 30381 - RNA, 21 nt, Artificial Sequence
  Marburg virus siRNA sense strand
ugggauggcauuguugcauca

SEQ ID NO: 30382 - RNA, 21 nt, Artificial Sequence
  Marburg virus siRNA sense strand
gggauggcauuguugcaucau

SEQ ID NO: 30383 - RNA, 21 nt, Artificial Sequence
  Marburg virus siRNA sense strand
ggauggcauuguugcaucauu

SEQ ID NO: 30384 - RNA, 21 nt, Artificial Sequence
  Marburg virus siRNA sense strand
gauggcauuguugcaucauuu

SEQ ID NO: 30385 - RNA, 21 nt, Artificial Sequence
  Marburg virus siRNA sense strand
auggcauuguugcaucauuua

SEQ ID NO: 30386 - RNA, 21 nt, Artificial Sequence
  Marburg virus siRNA sense strand
uggcauuguugcaucauuuaa

SEQ ID NO: 30387 - RNA, 21 nt, Artificial Sequence
  Marburg virus siRNA sense strand
ggcauuguugcaucauuuaaa

SEQ ID NO: 30388 - RNA, 21 nt, Artificial Sequence
  Marburg virus siRNA sense strand
gcauuguugcaucauuuaaag

SEQ ID NO: 30389 - RNA, 21 nt, Artificial Sequence
  Marburg virus siRNA sense strand
cauuguugcaucauuuaaagu

SEQ ID NO: 30390 - RNA, 21 nt, Artificial Sequence
  Marburg virus siRNA sense strand
auuguugcaucauuuaaaguc

SEQ ID NO: 30391 - RNA, 21 nt, Artificial Sequence
  Marburg virus siRNA sense strand
uuguugcaucauuuaaagucu

SEQ ID NO: 30392 - RNA, 21 nt, Artificial Sequence
  Marburg virus siRNA sense strand
uguugcaucauuuaaagucua

SEQ ID NO: 30393 - RNA, 21 nt, Artificial Sequence
  Marburg virus siRNA sense strand
guugcaucauuuaaagucuaa

SEQ ID NO: 30394 - RNA, 21 nt, Artificial Sequence
  Marburg virus siRNA sense strand
uugcaucauuuaaagucuaac

SEQ ID NO: 30395 - RNA, 21 nt, Artificial Sequence
  Marburg virus siRNA sense strand
ugcaucauuuaaagucuaacu

SEQ ID NO: 30396 - RNA, 21 nt, Artificial Sequence
  Marburg virus siRNA sense strand
gcaucauuuaaagucuaacuu

SEQ ID NO: 30397 - RNA, 21 nt, Artificial Sequence
  Marburg virus siRNA sense strand
caucauuuaaagucuaacuuc

SEQ ID NO: 30398 - RNA, 21 nt, Artificial Sequence
  Marburg virus siRNA sense strand
aucauuuaaagucuaacuucg

SEQ ID NO: 30399 - RNA, 21 nt, Artificial Sequence
  Marburg virus siRNA sense strand
ucauuuaaagucuaacuucgu

SEQ ID NO: 30400 - RNA, 21 nt, Artificial Sequence
  Marburg virus siRNA sense strand
cauuuaaagucuaacuucguu

SEQ ID NO: 30401 - RNA, 21 nt, Artificial Sequence
  Marburg virus siRNA sense strand
auuuaaagucuaacuucguug

SEQ ID NO: 30402 - RNA, 21 nt, Artificial Sequence
  Marburg virus siRNA sense strand
uuuaaagucuaacuucguugu

SEQ ID NO: 30403 - RNA, 21 nt, Artificial Sequence
  Marburg virus siRNA sense strand
uuaaagucuaacuucguuguu

SEQ ID NO: 30404 - RNA, 21 nt, Artificial Sequence
  Marburg virus siRNA sense strand
uaaagucuaacuucguuguuc

SEQ ID NO: 30405 - RNA, 21 nt, Artificial Sequence
  Marburg virus siRNA sense strand
aaagucuaacuucguuguucc

SEQ ID NO: 30406 - RNA, 21 nt, Artificial Sequence
  Marburg virus siRNA sense strand
aagucuaacuucguuguucca

SEQ ID NO: 30407 - RNA, 21 nt, Artificial Sequence
  Marburg virus siRNA sense strand
agucuaacuucguuguuccag

SEQ ID NO: 30408 - RNA, 21 nt, Artificial Sequence
  Marburg virus siRNA sense strand
gucuaacuucguuguuccaga

SEQ ID NO: 30409 - RNA, 21 nt, Artificial Sequence
  Marburg virus siRNA sense strand
ucuaacuucguuguuccagag

SEQ ID NO: 30410 - RNA, 21 nt, Artificial Sequence
  Marburg virus siRNA sense strand
cuaacuucguuguuccagagu

SEQ ID NO: 30411 - RNA, 21 nt, Artificial Sequence
  Marburg virus siRNA sense strand
uaacuucguuguuccagagug

SEQ ID NO: 30412 - RNA, 21 nt, Artificial Sequence
  Marburg virus siRNA sense strand
aacuucguuguuccagagugg

SEQ ID NO: 30413 - RNA, 21 nt, Artificial Sequence
  Marburg virus siRNA sense strand
acuucguuguuccagaguggc

SEQ ID NO: 30414 - RNA, 21 nt, Artificial Sequence
  Marburg virus siRNA sense strand
cuucguuguuccagaguggca

SEQ ID NO: 30415 - RNA, 21 nt, Artificial Sequence
  Marburg virus siRNA sense strand
uucguuguuccagaguggcaa

SEQ ID NO: 30416 - RNA, 21 nt, Artificial Sequence
  Marburg virus siRNA sense strand
ucguuguuccagaguggcaac

SEQ ID NO: 30417 - RNA, 21 nt, Artificial Sequence
  Marburg virus siRNA sense strand
cguuguuccagaguggcaaca

SEQ ID NO: 30418 - RNA, 21 nt, Artificial Sequence
  Marburg virus siRNA sense strand
guuguuccagaguggcaacaa

SEQ ID NO: 30419 - RNA, 21 nt, Artificial Sequence
  Marburg virus siRNA sense strand
uuguuccagaguggcaacaaa

SEQ ID NO: 30420 - RNA, 21 nt, Artificial Sequence
  Marburg virus siRNA sense strand
uguuccagaguggcaacaaac

SEQ ID NO: 30421 - RNA, 21 nt, Artificial Sequence
  Marburg virus siRNA sense strand
guuccagaguggcaacaaaca

SEQ ID NO: 30422 - RNA, 21 nt, Artificial Sequence
  Marburg virus siRNA sense strand
uuccagaguggcaacaaacaa

SEQ ID NO: 30423 - RNA, 21 nt, Artificial Sequence
  Marburg virus siRNA sense strand
uccagaguggcaacaaacaag

SEQ ID NO: 30424 - RNA, 21 nt, Artificial Sequence
  Marburg virus siRNA sense strand
ccagaguggcaacaaacaagg

SEQ ID NO: 30425 - RNA, 21 nt, Artificial Sequence
  Marburg virus siRNA sense strand
cagaguggcaacaaacaagga

SEQ ID NO: 30426 - RNA, 21 nt, Artificial Sequence
  Marburg virus siRNA sense strand
agaguggcaacaaacaaggaa

SEQ ID NO: 30427 - RNA, 21 nt, Artificial Sequence
  Marburg virus siRNA sense strand
gaguggcaacaaacaaggaau

SEQ ID NO: 30428 - RNA, 21 nt, Artificial Sequence
  Marburg virus siRNA sense strand
aguggcaacaaacaaggaauc

SEQ ID NO: 30429 - RNA, 21 nt, Artificial Sequence
  Marburg virus siRNA sense strand
guggcaacaaacaaggaaucu

SEQ ID NO: 30430 - RNA, 21 nt, Artificial Sequence
  Marburg virus siRNA sense strand
uggcaacaaacaaggaaucua

SEQ ID NO: 30431 - RNA, 21 nt, Artificial Sequence
  Marburg virus siRNA sense strand
ggcaacaaacaaggaaucuau

SEQ ID NO: 30432 - RNA, 21 nt, Artificial Sequence
  Marburg virus siRNA sense strand
gcaacaaacaaggaaucuauu

SEQ ID NO: 30433 - RNA, 21 nt, Artificial Sequence
  Marburg virus siRNA sense strand
caacaaacaaggaaucuauuc

SEQ ID NO: 30434 - RNA, 21 nt, Artificial Sequence
  Marburg virus siRNA sense strand
aacaaacaaggaaucuauucu

SEQ ID NO: 30435 - RNA, 21 nt, Artificial Sequence
  Marburg virus siRNA sense strand
acaaacaaggaaucuauucuc

SEQ ID NO: 30436 - RNA, 21 nt, Artificial Sequence
  Marburg virus siRNA sense strand
caaacaaggaaucuauucucc

SEQ ID NO: 30437 - RNA, 21 nt, Artificial Sequence
  Marburg virus siRNA sense strand
aaacaaggaaucuauucuccc

SEQ ID NO: 30438 - RNA, 21 nt, Artificial Sequence
  Marburg virus siRNA sense strand
aacaaggaaucuauucuccca

SEQ ID NO: 30439 - RNA, 21 nt, Artificial Sequence
  Marburg virus siRNA sense strand
acaaggaaucuauucucccac

SEQ ID NO: 30440 - RNA, 21 nt, Artificial Sequence
  Marburg virus siRNA sense strand
caaggaaucuauucucccacc

SEQ ID NO: 30441 - RNA, 21 nt, Artificial Sequence
  Marburg virus siRNA sense strand
aaggaaucuauucucccaccu

SEQ ID NO: 30442 - RNA, 21 nt, Artificial Sequence
  Marburg virus siRNA sense strand
aggaaucuauucucccaccuc

SEQ ID NO: 30443 - RNA, 21 nt, Artificial Sequence
  Marburg virus siRNA sense strand
ggaaucuauucucccaccucu

SEQ ID NO: 30444 - RNA, 21 nt, Artificial Sequence
  Marburg virus siRNA sense strand
gaaucuauucucccaccucuu

SEQ ID NO: 30445 - RNA, 21 nt, Artificial Sequence
  Marburg virus siRNA sense strand
aaucuauucucccaccucuuu

SEQ ID NO: 30446 - RNA, 21 nt, Artificial Sequence
  Marburg virus siRNA sense strand
aucuauucucccaccucuuua

SEQ ID NO: 30447 - RNA, 21 nt, Artificial Sequence
  Marburg virus siRNA sense strand
ucuauucucccaccucuuuaa

SEQ ID NO: 30448 - RNA, 21 nt, Artificial Sequence
  Marburg virus siRNA sense strand
cuauucucccaccucuuuaaa

SEQ ID NO: 30449 - RNA, 21 nt, Artificial Sequence
  Marburg virus siRNA sense strand
uauucucccaccucuuuaaaa

SEQ ID NO: 30450 - RNA, 21 nt, Artificial Sequence
  Marburg virus siRNA sense strand
auucucccaccucuuuaaaaa

SEQ ID NO: 30451 - RNA, 21 nt, Artificial Sequence
  Marburg virus siRNA sense strand
uucucccaccucuuuaaaaac

SEQ ID NO: 30452 - RNA, 21 nt, Artificial Sequence
  Marburg virus siRNA sense strand
ucucccaccucuuuaaaaacc

SEQ ID NO: 30453 - RNA, 21 nt, Artificial Sequence
  Marburg virus siRNA sense strand
cucccaccucuuuaaaaaccc

SEQ ID NO: 30454 - RNA, 21 nt, Artificial Sequence
  Marburg virus siRNA sense strand
ucccaccucuuuaaaaaccca

SEQ ID NO: 30455 - RNA, 21 nt, Artificial Sequence
  Marburg virus siRNA sense strand
cccaccucuuuaaaaacccaa

SEQ ID NO: 30456 - RNA, 21 nt, Artificial Sequence
  Marburg virus siRNA sense strand
ccaccucuuuaaaaacccaaa

SEQ ID NO: 30457 - RNA, 21 nt, Artificial Sequence
  Marburg virus siRNA sense strand
caccucuuuaaaaacccaaag

SEQ ID NO: 30458 - RNA, 21 nt, Artificial Sequence
  Marburg virus siRNA sense strand
accucuuuaaaaacccaaagu

SEQ ID NO: 30459 - RNA, 21 nt, Artificial Sequence
  Marburg virus siRNA sense strand
ccucuuuaaaaacccaaaguc

SEQ ID NO: 30460 - RNA, 21 nt, Artificial Sequence
  Marburg virus siRNA sense strand
cucuuuaaaaacccaaaguca

SEQ ID NO: 30461 - RNA, 21 nt, Artificial Sequence
  Marburg virus siRNA sense strand
ucuuuaaaaacccaaagucaa

SEQ ID NO: 30462 - RNA, 21 nt, Artificial Sequence
  Marburg virus siRNA sense strand
cuuuaaaaacccaaagucaac

SEQ ID NO: 30463 - RNA, 21 nt, Artificial Sequence
  Marburg virus siRNA sense strand
uuuaaaaacccaaagucaaca

SEQ ID NO: 30464 - RNA, 21 nt, Artificial Sequence
  Marburg virus siRNA sense strand
uuaaaaacccaaagucaacaa

SEQ ID NO: 30465 - RNA, 21 nt, Artificial Sequence
  Marburg virus siRNA sense strand
uaaaaacccaaagucaacaau

SEQ ID NO: 30466 - RNA, 21 nt, Artificial Sequence
  Marburg virus siRNA sense strand
aaaaacccaaagucaacaauu

SEQ ID NO: 30467 - RNA, 21 nt, Artificial Sequence
  Marburg virus siRNA sense strand
aaaacccaaagucaacaauua

SEQ ID NO: 30468 - RNA, 21 nt, Artificial Sequence
  Marburg virus siRNA sense strand
aaacccaaagucaacaauuau

SEQ ID NO: 30469 - RNA, 21 nt, Artificial Sequence
  Marburg virus siRNA sense strand
aacccaaagucaacaauuaua

SEQ ID NO: 30470 - RNA, 21 nt, Artificial Sequence
  Marburg virus siRNA sense strand
acccaaagucaacaauuauag

SEQ ID NO: 30471 - RNA, 21 nt, Artificial Sequence
  Marburg virus siRNA sense strand
cccaaagucaacaauuauaga

SEQ ID NO: 30472 - RNA, 21 nt, Artificial Sequence
  Marburg virus siRNA sense strand
ccaaagucaacaauuauagaa

SEQ ID NO: 30473 - RNA, 21 nt, Artificial Sequence
  Marburg virus siRNA sense strand
caaagucaacaauuauagaac

SEQ ID NO: 30474 - RNA, 21 nt, Artificial Sequence
  Marburg virus siRNA sense strand
aaagucaacaauuauagaacc

SEQ ID NO: 30475 - RNA, 21 nt, Artificial Sequence
  Marburg virus siRNA sense strand
aagucaacaauuauagaaccg

SEQ ID NO: 30476 - RNA, 21 nt, Artificial Sequence
  Marburg virus siRNA sense strand
agucaacaauuauagaaccgu

SEQ ID NO: 30477 - RNA, 21 nt, Artificial Sequence
  Marburg virus siRNA sense strand
gucaacaauuauagaaccguu

SEQ ID NO: 30478 - RNA, 21 nt, Artificial Sequence
  Marburg virus siRNA sense strand
ucaacaauuauagaaccguuc

SEQ ID NO: 30479 - RNA, 21 nt, Artificial Sequence
  Marburg virus siRNA sense strand
caacaauuauagaaccguucu

SEQ ID NO: 30480 - RNA, 21 nt, Artificial Sequence
  Marburg virus siRNA sense strand
aacaauuauagaaccguucuu

SEQ ID NO: 30481 - RNA, 21 nt, Artificial Sequence
  Marburg virus siRNA sense strand
acaauuauagaaccguucuug

SEQ ID NO: 30482 - RNA, 21 nt, Artificial Sequence
  Marburg virus siRNA sense strand
caauuauagaaccguucuugg

SEQ ID NO: 30483 - RNA, 21 nt, Artificial Sequence
  Marburg virus siRNA sense strand
aauuauagaaccguucuuggc

SEQ ID NO: 30484 - RNA, 21 nt, Artificial Sequence
  Marburg virus siRNA sense strand
auuauagaaccguucuuggcu

SEQ ID NO: 30485 - RNA, 21 nt, Artificial Sequence
  Marburg virus siRNA sense strand
uuauagaaccguucuuggcuu

SEQ ID NO: 30486 - RNA, 21 nt, Artificial Sequence
  Marburg virus siRNA sense strand
uauagaaccguucuuggcuuu

SEQ ID NO: 30487 - RNA, 21 nt, Artificial Sequence
  Marburg virus siRNA sense strand
auagaaccguucuuggcuuug

SEQ ID NO: 30488 - RNA, 21 nt, Artificial Sequence
  Marburg virus siRNA sense strand
uagaaccguucuuggcuuuga

SEQ ID NO: 30489 - RNA, 21 nt, Artificial Sequence
  Marburg virus siRNA sense strand
agaaccguucuuggcuuugag

SEQ ID NO: 30490 - RNA, 21 nt, Artificial Sequence
  Marburg virus siRNA sense strand
gaaccguucuuggcuuugagg

SEQ ID NO: 30491 - RNA, 21 nt, Artificial Sequence
  Marburg virus siRNA sense strand
aaccguucuuggcuuugagga

SEQ ID NO: 30492 - RNA, 21 nt, Artificial Sequence
  Marburg virus siRNA sense strand
accguucuuggcuuugaggau

SEQ ID NO: 30493 - RNA, 21 nt, Artificial Sequence
  Marburg virus siRNA sense strand
ccguucuuggcuuugaggauc

SEQ ID NO: 30494 - RNA, 21 nt, Artificial Sequence
  Marburg virus siRNA sense strand
cguucuuggcuuugaggaucu

SEQ ID NO: 30495 - RNA, 21 nt, Artificial Sequence
  Marburg virus siRNA sense strand
guucuuggcuuugaggaucuu

SEQ ID NO: 30496 - RNA, 21 nt, Artificial Sequence
  Marburg virus siRNA sense strand
uucuuggcuuugaggaucuug

SEQ ID NO: 30497 - RNA, 21 nt, Artificial Sequence
  Marburg virus siRNA sense strand
ucuuggcuuugaggaucuugc

SEQ ID NO: 30498 - RNA, 21 nt, Artificial Sequence
  Marburg virus siRNA sense strand
cuuggcuuugaggaucuugcu

SEQ ID NO: 30499 - RNA, 21 nt, Artificial Sequence
  Marburg virus siRNA sense strand
uuggcuuugaggaucuugcuu

SEQ ID NO: 30500 - RNA, 21 nt, Artificial Sequence
  Marburg virus siRNA sense strand
uggcuuugaggaucuugcuug

SEQ ID NO: 30501 - RNA, 21 nt, Artificial Sequence
  Marburg virus siRNA sense strand
ggcuuugaggaucuugcuugg

SEQ ID NO: 30502 - RNA, 21 nt, Artificial Sequence
  Marburg virus siRNA sense strand
gcuuugaggaucuugcuugga

SEQ ID NO: 30503 - RNA, 21 nt, Artificial Sequence
  Marburg virus siRNA sense strand
cuuugaggaucuugcuuggag

SEQ ID NO: 30504 - RNA, 21 nt, Artificial Sequence
  Marburg virus siRNA sense strand
uuugaggaucuugcuuggagu

SEQ ID NO: 30505 - RNA, 21 nt, Artificial Sequence
  Marburg virus siRNA sense strand
uugaggaucuugcuuggaguu

SEQ ID NO: 30506 - RNA, 21 nt, Artificial Sequence
  Marburg virus siRNA sense strand
ugaggaucuugcuuggaguug

SEQ ID NO: 30507 - RNA, 21 nt, Artificial Sequence
  Marburg virus siRNA sense strand
gaggaucuugcuuggaguugc

SEQ ID NO: 30508 - RNA, 21 nt, Artificial Sequence
  Marburg virus siRNA sense strand
aggaucuugcuuggaguugcu

SEQ ID NO: 30509 - RNA, 21 nt, Artificial Sequence
  Marburg virus siRNA sense strand
ggaucuugcuuggaguugcuu

SEQ ID NO: 30510 - RNA, 21 nt, Artificial Sequence
  Marburg virus siRNA sense strand
gaucuugcuuggaguugcuuu

SEQ ID NO: 30511 - RNA, 21 nt, Artificial Sequence
  Marburg virus siRNA sense strand
aucuugcuuggaguugcuuug

SEQ ID NO: 30512 - RNA, 21 nt, Artificial Sequence
  Marburg virus siRNA sense strand
ucuugcuuggaguugcuuuga

SEQ ID NO: 30513 - RNA, 21 nt, Artificial Sequence
  Marburg virus siRNA sense strand
cuugcuuggaguugcuuugaa

SEQ ID NO: 30514 - RNA, 21 nt, Artificial Sequence
  Marburg virus siRNA sense strand
uugcuuggaguugcuuugaag

SEQ ID NO: 30515 - RNA, 21 nt, Artificial Sequence
  Marburg virus siRNA sense strand
ugcuuggaguugcuuugaagg

SEQ ID NO: 30516 - RNA, 21 nt, Artificial Sequence
  Marburg virus siRNA sense strand
gcuuggaguugcuuugaagga

SEQ ID NO: 30517 - RNA, 21 nt, Artificial Sequence
  Marburg virus siRNA sense strand
cuuggaguugcuuugaaggau

SEQ ID NO: 30518 - RNA, 21 nt, Artificial Sequence
  Marburg virus siRNA sense strand
uuggaguugcuuugaaggauc

SEQ ID NO: 30519 - RNA, 21 nt, Artificial Sequence
  Marburg virus siRNA sense strand
uggaguugcuuugaaggauca

SEQ ID NO: 30520 - RNA, 21 nt, Artificial Sequence
  Marburg virus siRNA sense strand
ggaguugcuuugaaggaucaa

SEQ ID NO: 30521 - RNA, 21 nt, Artificial Sequence
  Marburg virus siRNA sense strand
gaguugcuuugaaggaucaag

SEQ ID NO: 30522 - RNA, 21 nt, Artificial Sequence
  Marburg virus siRNA sense strand
aguugcuuugaaggaucaaga

SEQ ID NO: 30523 - RNA, 21 nt, Artificial Sequence
  Marburg virus siRNA sense strand
guugcuuugaaggaucaagaa

SEQ ID NO: 30524 - RNA, 21 nt, Artificial Sequence
  Marburg virus siRNA sense strand
uugcuuugaaggaucaagaau

SEQ ID NO: 30525 - RNA, 21 nt, Artificial Sequence
  Marburg virus siRNA sense strand
ugcuuugaaggaucaagaauu

SEQ ID NO: 30526 - RNA, 21 nt, Artificial Sequence
  Marburg virus siRNA sense strand
gcuuugaaggaucaagaauua

SEQ ID NO: 30527 - RNA, 21 nt, Artificial Sequence
  Marburg virus siRNA sense strand
cuuugaaggaucaagaauuac

SEQ ID NO: 30528 - RNA, 21 nt, Artificial Sequence
  Marburg virus siRNA sense strand
uuugaaggaucaagaauuaca

SEQ ID NO: 30529 - RNA, 21 nt, Artificial Sequence
  Marburg virus siRNA sense strand
uugaaggaucaagaauuacag

SEQ ID NO: 30530 - RNA, 21 nt, Artificial Sequence
  Marburg virus siRNA sense strand
ugaaggaucaagaauuacagc

SEQ ID NO: 30531 - RNA, 21 nt, Artificial Sequence
  Marburg virus siRNA sense strand
gaaggaucaagaauuacagca

SEQ ID NO: 30532 - RNA, 21 nt, Artificial Sequence
  Marburg virus siRNA sense strand
aaggaucaagaauuacagcaa

SEQ ID NO: 30533 - RNA, 21 nt, Artificial Sequence
  Marburg virus siRNA sense strand
aggaucaagaauuacagcaau

SEQ ID NO: 30534 - RNA, 21 nt, Artificial Sequence
  Marburg virus siRNA sense strand
ggaucaagaauuacagcaauc

SEQ ID NO: 30535 - RNA, 21 nt, Artificial Sequence
  Marburg virus siRNA sense strand
gaucaagaauuacagcaauca

SEQ ID NO: 30536 - RNA, 21 nt, Artificial Sequence
  Marburg virus siRNA sense strand
aucaagaauuacagcaaucau

SEQ ID NO: 30537 - RNA, 21 nt, Artificial Sequence
  Marburg virus siRNA sense strand
ucaagaauuacagcaaucauu

SEQ ID NO: 30538 - RNA, 21 nt, Artificial Sequence
  Marburg virus siRNA sense strand
caagaauuacagcaaucauua

SEQ ID NO: 30539 - RNA, 21 nt, Artificial Sequence
  Marburg virus siRNA sense strand
aagaauuacagcaaucauuaa

SEQ ID NO: 30540 - RNA, 21 nt, Artificial Sequence
  Marburg virus siRNA sense strand
agaauuacagcaaucauuaau

SEQ ID NO: 30541 - RNA, 21 nt, Artificial Sequence
  Marburg virus siRNA sense strand
gaauuacagcaaucauuaauu

SEQ ID NO: 30542 - RNA, 21 nt, Artificial Sequence
  Marburg virus siRNA sense strand
aauuacagcaaucauuaauuc

SEQ ID NO: 30543 - RNA, 21 nt, Artificial Sequence
  Marburg virus siRNA sense strand
auuacagcaaucauuaauucc

SEQ ID NO: 30544 - RNA, 21 nt, Artificial Sequence
  Marburg virus siRNA sense strand
uuacagcaaucauuaauuccu

SEQ ID NO: 30545 - RNA, 21 nt, Artificial Sequence
  Marburg virus siRNA sense strand
uacagcaaucauuaauuccug

SEQ ID NO: 30546 - RNA, 21 nt, Artificial Sequence
  Marburg virus siRNA sense strand
acagcaaucauuaauuccugg

SEQ ID NO: 30547 - RNA, 21 nt, Artificial Sequence
  Marburg virus siRNA sense strand
cagcaaucauuaauuccugga

SEQ ID NO: 30548 - RNA, 21 nt, Artificial Sequence
  Marburg virus siRNA sense strand
agcaaucauuaauuccuggau

SEQ ID NO: 30549 - RNA, 21 nt, Artificial Sequence
  Marburg virus siRNA sense strand
gcaaucauuaauuccuggauu

SEQ ID NO: 30550 - RNA, 21 nt, Artificial Sequence
  Marburg virus siRNA sense strand
caaucauuaauuccuggauuu

SEQ ID NO: 30551 - RNA, 21 nt, Artificial Sequence
  Marburg virus siRNA sense strand
aaucauuaauuccuggauuua

SEQ ID NO: 30552 - RNA, 21 nt, Artificial Sequence
  Marburg virus siRNA sense strand
aucauuaauuccuggauuuag

SEQ ID NO: 30553 - RNA, 21 nt, Artificial Sequence
  Marburg virus siRNA sense strand
ucauuaauuccuggauuuaga

SEQ ID NO: 30554 - RNA, 21 nt, Artificial Sequence
  Marburg virus siRNA sense strand
cauuaauuccuggauuuagau

SEQ ID NO: 30555 - RNA, 21 nt, Artificial Sequence
  Marburg virus siRNA sense strand
auuaauuccuggauuuagauc

SEQ ID NO: 30556 - RNA, 21 nt, Artificial Sequence
  Marburg virus siRNA sense strand
uuaauuccuggauuuagaucu

SEQ ID NO: 30557 - RNA, 21 nt, Artificial Sequence
  Marburg virus siRNA sense strand
uaauuccuggauuuagaucua

SEQ ID NO: 30558 - RNA, 21 nt, Artificial Sequence
  Marburg virus siRNA sense strand
aauuccuggauuuagaucuau

SEQ ID NO: 30559 - RNA, 21 nt, Artificial Sequence
  Marburg virus siRNA sense strand
auuccuggauuuagaucuauu

SEQ ID NO: 30560 - RNA, 21 nt, Artificial Sequence
  Marburg virus siRNA sense strand
uuccuggauuuagaucuauug

SEQ ID NO: 30561 - RNA, 21 nt, Artificial Sequence
  Marburg virus siRNA sense strand
uccuggauuuagaucuauugu

SEQ ID NO: 30562 - RNA, 21 nt, Artificial Sequence
  Marburg virus siRNA sense strand
ccuggauuuagaucuauuguu

SEQ ID NO: 30563 - RNA, 21 nt, Artificial Sequence
  Marburg virus siRNA sense strand
cuggauuuagaucuauuguuc

SEQ ID NO: 30564 - RNA, 21 nt, Artificial Sequence
  Marburg virus siRNA sense strand
uggauuuagaucuauuguuca

SEQ ID NO: 30565 - RNA, 21 nt, Artificial Sequence
  Marburg virus siRNA sense strand
ggauuuagaucuauuguucau

SEQ ID NO: 30566 - RNA, 21 nt, Artificial Sequence
  Marburg virus siRNA sense strand
gauuuagaucuauuguucaua

SEQ ID NO: 30567 - RNA, 21 nt, Artificial Sequence
  Marburg virus siRNA sense strand
auuuagaucuauuguucauau

SEQ ID NO: 30568 - RNA, 21 nt, Artificial Sequence
  Marburg virus siRNA sense strand
uuuagaucuauuguucauaug

SEQ ID NO: 30569 - RNA, 21 nt, Artificial Sequence
  Marburg virus siRNA sense strand
uuagaucuauuguucauaugc

SEQ ID NO: 30570 - RNA, 21 nt, Artificial Sequence
  Marburg virus siRNA sense strand
uagaucuauuguucauaugcu

SEQ ID NO: 30571 - RNA, 21 nt, Artificial Sequence
  Marburg virus siRNA sense strand
agaucuauuguucauaugcuu

SEQ ID NO: 30572 - RNA, 21 nt, Artificial Sequence
  Marburg virus siRNA sense strand
gaucuauuguucauaugcuuu

SEQ ID NO: 30573 - RNA, 21 nt, Artificial Sequence
  Marburg virus siRNA sense strand
aucuauuguucauaugcuuuc

SEQ ID NO: 30574 - RNA, 21 nt, Artificial Sequence
  Marburg virus siRNA sense strand
ucuauuguucauaugcuuuca

SEQ ID NO: 30575 - RNA, 21 nt, Artificial Sequence
  Marburg virus siRNA sense strand
cuauuguucauaugcuuucag

SEQ ID NO: 30576 - RNA, 21 nt, Artificial Sequence
  Marburg virus siRNA sense strand
uauuguucauaugcuuucaga

SEQ ID NO: 30577 - RNA, 21 nt, Artificial Sequence
  Marburg virus siRNA sense strand
auuguucauaugcuuucagaa

SEQ ID NO: 30578 - RNA, 21 nt, Artificial Sequence
  Marburg virus siRNA sense strand
uuguucauaugcuuucagaau

SEQ ID NO: 30579 - RNA, 21 nt, Artificial Sequence
  Marburg virus siRNA sense strand
uguucauaugcuuucagaaug

SEQ ID NO: 30580 - RNA, 21 nt, Artificial Sequence
  Marburg virus siRNA sense strand
guucauaugcuuucagaaugg

SEQ ID NO: 30581 - RNA, 21 nt, Artificial Sequence
  Marburg virus siRNA sense strand
uucauaugcuuucagaauggu

SEQ ID NO: 30582 - RNA, 21 nt, Artificial Sequence
  Marburg virus siRNA sense strand
ucauaugcuuucagaaugguu

SEQ ID NO: 30583 - RNA, 21 nt, Artificial Sequence
  Marburg virus siRNA sense strand
cauaugcuuucagaaugguug

SEQ ID NO: 30584 - RNA, 21 nt, Artificial Sequence
  Marburg virus siRNA sense strand
auaugcuuucagaaugguugc

SEQ ID NO: 30585 - RNA, 21 nt, Artificial Sequence
  Marburg virus siRNA sense strand
uaugcuuucagaaugguugcu

SEQ ID NO: 30586 - RNA, 21 nt, Artificial Sequence
  Marburg virus siRNA sense strand
augcuuucagaaugguugcuc

SEQ ID NO: 30587 - RNA, 21 nt, Artificial Sequence
  Marburg virus siRNA sense strand
ugcuuucagaaugguugcucc

SEQ ID NO: 30588 - RNA, 21 nt, Artificial Sequence
  Marburg virus siRNA sense strand
gcuuucagaaugguugcuccu

SEQ ID NO: 30589 - RNA, 21 nt, Artificial Sequence
  Marburg virus siRNA sense strand
cuuucagaaugguugcuccua

SEQ ID NO: 30590 - RNA, 21 nt, Artificial Sequence
  Marburg virus siRNA sense strand
uuucagaaugguugcuccuag

SEQ ID NO: 30591 - RNA, 21 nt, Artificial Sequence
  Marburg virus siRNA sense strand
uucagaaugguugcuccuaga

SEQ ID NO: 30592 - RNA, 21 nt, Artificial Sequence
  Marburg virus siRNA sense strand
ucagaaugguugcuccuagag

SEQ ID NO: 30593 - RNA, 21 nt, Artificial Sequence
  Marburg virus siRNA sense strand
cagaaugguugcuccuagagg

SEQ ID NO: 30594 - RNA, 21 nt, Artificial Sequence
  Marburg virus siRNA sense strand
agaaugguugcuccuagaggu

SEQ ID NO: 30595 - RNA, 21 nt, Artificial Sequence
  Marburg virus siRNA sense strand
gaaugguugcuccuagaggua

SEQ ID NO: 30596 - RNA, 21 nt, Artificial Sequence
  Marburg virus siRNA sense strand
aaugguugcuccuagagguaa

SEQ ID NO: 30597 - RNA, 21 nt, Artificial Sequence
  Marburg virus siRNA sense strand
augguugcuccuagagguaac

SEQ ID NO: 30598 - RNA, 21 nt, Artificial Sequence
  Marburg virus siRNA sense strand
ugguugcuccuagagguaacg

SEQ ID NO: 30599 - RNA, 21 nt, Artificial Sequence
  Marburg virus siRNA sense strand
gguugcuccuagagguaacgu

SEQ ID NO: 30600 - RNA, 21 nt, Artificial Sequence
  Marburg virus siRNA sense strand
guugcuccuagagguaacguc

SEQ ID NO: 30601 - RNA, 21 nt, Artificial Sequence
  Marburg virus siRNA sense strand
uugcuccuagagguaacgucg

SEQ ID NO: 30602 - RNA, 21 nt, Artificial Sequence
  Marburg virus siRNA sense strand
ugcuccuagagguaacgucgg

SEQ ID NO: 30603 - RNA, 21 nt, Artificial Sequence
  Marburg virus siRNA sense strand
gcuccuagagguaacgucggc

SEQ ID NO: 30604 - RNA, 21 nt, Artificial Sequence
  Marburg virus siRNA sense strand
cuccuagagguaacgucggca

SEQ ID NO: 30605 - RNA, 21 nt, Artificial Sequence
  Marburg virus siRNA sense strand
uccuagagguaacgucggcaa

SEQ ID NO: 30606 - RNA, 21 nt, Artificial Sequence
  Marburg virus siRNA sense strand
ccuagagguaacgucggcaau

SEQ ID NO: 30607 - RNA, 21 nt, Artificial Sequence
  Marburg virus siRNA sense strand
cuagagguaacgucggcaauc

SEQ ID NO: 30608 - RNA, 21 nt, Artificial Sequence
  Marburg virus siRNA sense strand
uagagguaacgucggcaaucc

SEQ ID NO: 30609 - RNA, 21 nt, Artificial Sequence
  Marburg virus siRNA sense strand
agagguaacgucggcaaucca

SEQ ID NO: 30610 - RNA, 21 nt, Artificial Sequence
  Marburg virus siRNA sense strand
gagguaacgucggcaauccau

SEQ ID NO: 30611 - RNA, 21 nt, Artificial Sequence
  Marburg virus siRNA sense strand
agguaacgucggcaauccaua

SEQ ID NO: 30612 - RNA, 21 nt, Artificial Sequence
  Marburg virus siRNA sense strand
gguaacgucggcaauccauau

SEQ ID NO: 30613 - RNA, 21 nt, Artificial Sequence
  Marburg virus siRNA sense strand
guaacgucggcaauccauauu

SEQ ID NO: 30614 - RNA, 21 nt, Artificial Sequence
  Marburg virus siRNA sense strand
uaacgucggcaauccauauua

SEQ ID NO: 30615 - RNA, 21 nt, Artificial Sequence
  Marburg virus siRNA sense strand
aacgucggcaauccauauuag

SEQ ID NO: 30616 - RNA, 21 nt, Artificial Sequence
  Marburg virus siRNA sense strand
acgucggcaauccauauuagc

SEQ ID NO: 30617 - RNA, 21 nt, Artificial Sequence
  Marburg virus siRNA sense strand
cgucggcaauccauauuagcc

SEQ ID NO: 30618 - RNA, 21 nt, Artificial Sequence
  Marburg virus siRNA sense strand
gucggcaauccauauuagccc

SEQ ID NO: 30619 - RNA, 21 nt, Artificial Sequence
  Marburg virus siRNA sense strand
ucggcaauccauauuagcccc

SEQ ID NO: 30620 - RNA, 21 nt, Artificial Sequence
  Marburg virus siRNA sense strand
cggcaauccauauuagcccca

SEQ ID NO: 30621 - RNA, 21 nt, Artificial Sequence
  Marburg virus siRNA sense strand
ggcaauccauauuagccccaa

SEQ ID NO: 30622 - RNA, 21 nt, Artificial Sequence
  Marburg virus siRNA sense strand
gcaauccauauuagccccaau

SEQ ID NO: 30623 - RNA, 21 nt, Artificial Sequence
  Marburg virus siRNA sense strand
caauccauauuagccccaauc

SEQ ID NO: 30624 - RNA, 21 nt, Artificial Sequence
  Marburg virus siRNA sense strand
aauccauauuagccccaaucu

SEQ ID NO: 30625 - RNA, 21 nt, Artificial Sequence
  Marburg virus siRNA sense strand
auccauauuagccccaaucug

SEQ ID NO: 30626 - RNA, 21 nt, Artificial Sequence
  Marburg virus siRNA sense strand
uccauauuagccccaaucugu

SEQ ID NO: 30627 - RNA, 21 nt, Artificial Sequence
  Marburg virus siRNA sense strand
ccauauuagccccaaucuguu

SEQ ID NO: 30628 - RNA, 21 nt, Artificial Sequence
  Marburg virus siRNA sense strand
cauauuagccccaaucuguug

SEQ ID NO: 30629 - RNA, 21 nt, Artificial Sequence
  Marburg virus siRNA sense strand
auauuagccccaaucuguugg

SEQ ID NO: 30630 - RNA, 21 nt, Artificial Sequence
  Marburg virus siRNA sense strand
uauuagccccaaucuguuggg

SEQ ID NO: 30631 - RNA, 21 nt, Artificial Sequence
  Marburg virus siRNA sense strand
auuagccccaaucuguuggga

SEQ ID NO: 30632 - RNA, 21 nt, Artificial Sequence
  Marburg virus siRNA sense strand
uuagccccaaucuguugggaa

SEQ ID NO: 30633 - RNA, 21 nt, Artificial Sequence
  Marburg virus siRNA sense strand
uagccccaaucuguugggaau

SEQ ID NO: 30634 - RNA, 21 nt, Artificial Sequence
  Marburg virus siRNA sense strand
agccccaaucuguugggaauc

SEQ ID NO: 30635 - RNA, 21 nt, Artificial Sequence
  Marburg virus siRNA sense strand
gccccaaucuguugggaaucu

SEQ ID NO: 30636 - RNA, 21 nt, Artificial Sequence
  Marburg virus siRNA sense strand
ccccaaucuguugggaaucua

SEQ ID NO: 30637 - RNA, 21 nt, Artificial Sequence
  Marburg virus siRNA sense strand
cccaaucuguugggaaucuau

SEQ ID NO: 30638 - RNA, 21 nt, Artificial Sequence
  Marburg virus siRNA sense strand
ccaaucuguugggaaucuauu

SEQ ID NO: 30639 - RNA, 21 nt, Artificial Sequence
  Marburg virus siRNA sense strand
caaucuguugggaaucuauuu

SEQ ID NO: 30640 - RNA, 21 nt, Artificial Sequence
  Marburg virus siRNA sense strand
aaucuguugggaaucuauuug

SEQ ID NO: 30641 - RNA, 21 nt, Artificial Sequence
  Marburg virus siRNA sense strand
aucuguugggaaucuauuuga

SEQ ID NO: 30642 - RNA, 21 nt, Artificial Sequence
  Marburg virus siRNA sense strand
ucuguugggaaucuauuugac

SEQ ID NO: 30643 - RNA, 21 nt, Artificial Sequence
  Marburg virus siRNA sense strand
cuguugggaaucuauuugacc

SEQ ID NO: 30644 - RNA, 21 nt, Artificial Sequence
  Marburg virus siRNA sense strand
uguugggaaucuauuugaccu

SEQ ID NO: 30645 - RNA, 21 nt, Artificial Sequence
  Marburg virus siRNA sense strand
guugggaaucuauuugaccuc

SEQ ID NO: 30646 - RNA, 21 nt, Artificial Sequence
  Marburg virus siRNA sense strand
uugggaaucuauuugaccuca

SEQ ID NO: 30647 - RNA, 21 nt, Artificial Sequence
  Marburg virus siRNA sense strand
ugggaaucuauuugaccucag

SEQ ID NO: 30648 - RNA, 21 nt, Artificial Sequence
  Marburg virus siRNA sense strand
gggaaucuauuugaccucaga

SEQ ID NO: 30649 - RNA, 21 nt, Artificial Sequence
  Marburg virus siRNA sense strand
ggaaucuauuugaccucagac

SEQ ID NO: 30650 - RNA, 21 nt, Artificial Sequence
  Marburg virus siRNA sense strand
gaaucuauuugaccucagaca

SEQ ID NO: 30651 - RNA, 21 nt, Artificial Sequence
  Marburg virus siRNA sense strand
aaucuauuugaccucagacau

SEQ ID NO: 30652 - RNA, 21 nt, Artificial Sequence
  Marburg virus siRNA sense strand
aucuauuugaccucagacaug

SEQ ID NO: 30653 - RNA, 21 nt, Artificial Sequence
  Marburg virus siRNA sense strand
ucuauuugaccucagacaugu

SEQ ID NO: 30654 - RNA, 21 nt, Artificial Sequence
  Marburg virus siRNA sense strand
cuauuugaccucagacauguu

SEQ ID NO: 30655 - RNA, 21 nt, Artificial Sequence
  Marburg virus siRNA sense strand
uauuugaccucagacauguuu

SEQ ID NO: 30656 - RNA, 21 nt, Artificial Sequence
  Marburg virus siRNA sense strand
auuugaccucagacauguuua

SEQ ID NO: 30657 - RNA, 21 nt, Artificial Sequence
  Marburg virus siRNA sense strand
uuugaccucagacauguuuaa

SEQ ID NO: 30658 - RNA, 21 nt, Artificial Sequence
  Marburg virus siRNA sense strand
uugaccucagacauguuuaag

SEQ ID NO: 30659 - RNA, 21 nt, Artificial Sequence
  Marburg virus siRNA sense strand
ugaccucagacauguuuaaga

SEQ ID NO: 30660 - RNA, 21 nt, Artificial Sequence
  Marburg virus siRNA sense strand
gaccucagacauguuuaagau

SEQ ID NO: 30661 - RNA, 21 nt, Artificial Sequence
  Marburg virus siRNA sense strand
accucagacauguuuaagauu

SEQ ID NO: 30662 - RNA, 21 nt, Artificial Sequence
  Marburg virus siRNA sense strand
ccucagacauguuuaagauuc

SEQ ID NO: 30663 - RNA, 21 nt, Artificial Sequence
  Marburg virus siRNA sense strand
cucagacauguuuaagauucu

SEQ ID NO: 30664 - RNA, 21 nt, Artificial Sequence
  Marburg virus siRNA sense strand
ucagacauguuuaagauucug

SEQ ID NO: 30665 - RNA, 21 nt, Artificial Sequence
  Marburg virus siRNA sense strand
cagacauguuuaagauucuga

SEQ ID NO: 30666 - RNA, 21 nt, Artificial Sequence
  Marburg virus siRNA sense strand
agacauguuuaagauucugau

SEQ ID NO: 30667 - RNA, 21 nt, Artificial Sequence
  Marburg virus siRNA sense strand
gacauguuuaagauucugaug

SEQ ID NO: 30668 - RNA, 21 nt, Artificial Sequence
  Marburg virus siRNA sense strand
acauguuuaagauucugaugg

SEQ ID NO: 30669 - RNA, 21 nt, Artificial Sequence
  Marburg virus siRNA sense strand
cauguuuaagauucugauggc

SEQ ID NO: 30670 - RNA, 21 nt, Artificial Sequence
  Marburg virus siRNA sense strand
auguuuaagauucugauggca

SEQ ID NO: 30671 - RNA, 21 nt, Artificial Sequence
  Marburg virus siRNA sense strand
uguuuaagauucugauggcag

SEQ ID NO: 30672 - RNA, 21 nt, Artificial Sequence
  Marburg virus siRNA sense strand
guuuaagauucugauggcagg

SEQ ID NO: 30673 - RNA, 21 nt, Artificial Sequence
  Marburg virus siRNA sense strand
uuuaagauucugauggcaggu

SEQ ID NO: 30674 - RNA, 21 nt, Artificial Sequence
  Marburg virus siRNA sense strand
uuaagauucugauggcaggug

SEQ ID NO: 30675 - RNA, 21 nt, Artificial Sequence
  Marburg virus siRNA sense strand
uaagauucugauggcaggugu

SEQ ID NO: 30676 - RNA, 21 nt, Artificial Sequence
  Marburg virus siRNA sense strand
aagauucugauggcaggugug

SEQ ID NO: 30677 - RNA, 21 nt, Artificial Sequence
  Marburg virus siRNA sense strand
agauucugauggcagguguga

SEQ ID NO: 30678 - RNA, 21 nt, Artificial Sequence
  Marburg virus siRNA sense strand
gauucugauggcaggugugaa

SEQ ID NO: 30679 - RNA, 21 nt, Artificial Sequence
  Marburg virus siRNA sense strand
auucugauggcaggugugaaa

SEQ ID NO: 30680 - RNA, 21 nt, Artificial Sequence
  Marburg virus siRNA sense strand
uucugauggcaggugugaaaa

SEQ ID NO: 30681 - RNA, 21 nt, Artificial Sequence
  Marburg virus siRNA sense strand
ucugauggcaggugugaaaaa

SEQ ID NO: 30682 - RNA, 21 nt, Artificial Sequence
  Marburg virus siRNA sense strand
cugauggcaggugugaaaaau

SEQ ID NO: 30683 - RNA, 21 nt, Artificial Sequence
  Marburg virus siRNA sense strand
ugauggcaggugugaaaaauu

SEQ ID NO: 30684 - RNA, 21 nt, Artificial Sequence
  Marburg virus siRNA sense strand
gauggcaggugugaaaaauuu

SEQ ID NO: 30685 - RNA, 21 nt, Artificial Sequence
  Marburg virus siRNA sense strand
auggcaggugugaaaaauuuc

SEQ ID NO: 30686 - RNA, 21 nt, Artificial Sequence
  Marburg virus siRNA sense strand
uggcaggugugaaaaauuucu

SEQ ID NO: 30687 - RNA, 21 nt, Artificial Sequence
  Marburg virus siRNA sense strand
ggcaggugugaaaaauuucuu

SEQ ID NO: 30688 - RNA, 21 nt, Artificial Sequence
  Marburg virus siRNA sense strand
gcaggugugaaaaauuucuuu

SEQ ID NO: 30689 - RNA, 21 nt, Artificial Sequence
  Marburg virus siRNA sense strand
caggugugaaaaauuucuuua

SEQ ID NO: 30690 - RNA, 21 nt, Artificial Sequence
  Marburg virus siRNA sense strand
aggugugaaaaauuucuuuaa

SEQ ID NO: 30691 - RNA, 21 nt, Artificial Sequence
  Marburg virus siRNA sense strand
ggugugaaaaauuucuuuaau

SEQ ID NO: 30692 - RNA, 21 nt, Artificial Sequence
  Marburg virus siRNA sense strand
gugugaaaaauuucuuuaaua

SEQ ID NO: 30693 - RNA, 21 nt, Artificial Sequence
  Marburg virus siRNA sense strand
ugugaaaaauuucuuuaauaa

SEQ ID NO: 30694 - RNA, 21 nt, Artificial Sequence
  Marburg virus siRNA sense strand
gugaaaaauuucuuuaauaag

SEQ ID NO: 30695 - RNA, 21 nt, Artificial Sequence
  Marburg virus siRNA sense strand
ugaaaaauuucuuuaauaaga

SEQ ID NO: 30696 - RNA, 21 nt, Artificial Sequence
  Marburg virus siRNA sense strand
gaaaaauuucuuuaauaagau

SEQ ID NO: 30697 - RNA, 21 nt, Artificial Sequence
  Marburg virus siRNA sense strand
aaaaauuucuuuaauaagaug

SEQ ID NO: 30698 - RNA, 21 nt, Artificial Sequence
  Marburg virus siRNA sense strand
aaaauuucuuuaauaagaugu

SEQ ID NO: 30699 - RNA, 21 nt, Artificial Sequence
  Marburg virus siRNA sense strand
aaauuucuuuaauaagauguu

SEQ ID NO: 30700 - RNA, 21 nt, Artificial Sequence
  Marburg virus siRNA sense strand
aauuucuuuaauaagauguuc

SEQ ID NO: 30701 - RNA, 21 nt, Artificial Sequence
  Marburg virus siRNA sense strand
auuucuuuaauaagauguuca

SEQ ID NO: 30702 - RNA, 21 nt, Artificial Sequence
  Marburg virus siRNA sense strand
uuucuuuaauaagauguucac

SEQ ID NO: 30703 - RNA, 21 nt, Artificial Sequence
  Marburg virus siRNA sense strand
uucuuuaauaagauguucacu

SEQ ID NO: 30704 - RNA, 21 nt, Artificial Sequence
  Marburg virus siRNA sense strand
ucuuuaauaagauguucacuc

SEQ ID NO: 30705 - RNA, 21 nt, Artificial Sequence
  Marburg virus siRNA sense strand
cuuuaauaagauguucacucu

SEQ ID NO: 30706 - RNA, 21 nt, Artificial Sequence
  Marburg virus siRNA sense strand
uuuaauaagauguucacucuu

SEQ ID NO: 30707 - RNA, 21 nt, Artificial Sequence
  Marburg virus siRNA sense strand
uuaauaagauguucacucuuc

SEQ ID NO: 30708 - RNA, 21 nt, Artificial Sequence
  Marburg virus siRNA sense strand
uaauaagauguucacucuuca

SEQ ID NO: 30709 - RNA, 21 nt, Artificial Sequence
  Marburg virus siRNA sense strand
aauaagauguucacucuucau

SEQ ID NO: 30710 - RNA, 21 nt, Artificial Sequence
  Marburg virus siRNA sense strand
auaagauguucacucuucaug

SEQ ID NO: 30711 - RNA, 21 nt, Artificial Sequence
  Marburg virus siRNA sense strand
uaagauguucacucuucaugu

SEQ ID NO: 30712 - RNA, 21 nt, Artificial Sequence
  Marburg virus siRNA sense strand
aagauguucacucuucauguu

SEQ ID NO: 30713 - RNA, 21 nt, Artificial Sequence
  Marburg virus siRNA sense strand
agauguucacucuucauguug

SEQ ID NO: 30714 - RNA, 21 nt, Artificial Sequence
  Marburg virus siRNA sense strand
gauguucacucuucauguugu

SEQ ID NO: 30715 - RNA, 21 nt, Artificial Sequence
  Marburg virus siRNA sense strand
auguucacucuucauguugua

SEQ ID NO: 30716 - RNA, 21 nt, Artificial Sequence
  Marburg virus siRNA sense strand
uguucacucuucauguuguaa

SEQ ID NO: 30717 - RNA, 21 nt, Artificial Sequence
  Marburg virus siRNA sense strand
guucacucuucauguuguaaa

SEQ ID NO: 30718 - RNA, 21 nt, Artificial Sequence
  Marburg virus siRNA sense strand
uucacucuucauguuguaaau

SEQ ID NO: 30719 - RNA, 21 nt, Artificial Sequence
  Marburg virus siRNA sense strand
ucacucuucauguuguaaaug

SEQ ID NO: 30720 - RNA, 21 nt, Artificial Sequence
  Marburg virus siRNA sense strand
cacucuucauguuguaaauga

SEQ ID NO: 30721 - RNA, 21 nt, Artificial Sequence
  Marburg virus siRNA sense strand
acucuucauguuguaaaugac

SEQ ID NO: 30722 - RNA, 21 nt, Artificial Sequence
  Marburg virus siRNA sense strand
cucuucauguuguaaaugacc

SEQ ID NO: 30723 - RNA, 21 nt, Artificial Sequence
  Marburg virus siRNA sense strand
ucuucauguuguaaaugacca

SEQ ID NO: 30724 - RNA, 21 nt, Artificial Sequence
  Marburg virus siRNA sense strand
cuucauguuguaaaugaccac

SEQ ID NO: 30725 - RNA, 21 nt, Artificial Sequence
  Marburg virus siRNA sense strand
uucauguuguaaaugaccacg

SEQ ID NO: 30726 - RNA, 21 nt, Artificial Sequence
  Marburg virus siRNA sense strand
ucauguuguaaaugaccacgg

SEQ ID NO: 30727 - RNA, 21 nt, Artificial Sequence
  Marburg virus siRNA sense strand
cauguuguaaaugaccacgga

SEQ ID NO: 30728 - RNA, 21 nt, Artificial Sequence
  Marburg virus siRNA sense strand
auguuguaaaugaccacggaa

SEQ ID NO: 30729 - RNA, 21 nt, Artificial Sequence
  Marburg virus siRNA sense strand
uguuguaaaugaccacggaaa

SEQ ID NO: 30730 - RNA, 21 nt, Artificial Sequence
  Marburg virus siRNA sense strand
guuguaaaugaccacggaaaa

SEQ ID NO: 30731 - RNA, 21 nt, Artificial Sequence
  Marburg virus siRNA sense strand
uuguaaaugaccacggaaaac

SEQ ID NO: 30732 - RNA, 21 nt, Artificial Sequence
  Marburg virus siRNA sense strand
uguaaaugaccacggaaaacc

SEQ ID NO: 30733 - RNA, 21 nt, Artificial Sequence
  Marburg virus siRNA sense strand
guaaaugaccacggaaaaccc

SEQ ID NO: 30734 - RNA, 21 nt, Artificial Sequence
  Marburg virus siRNA sense strand
uaaaugaccacggaaaaccca

SEQ ID NO: 30735 - RNA, 21 nt, Artificial Sequence
  Marburg virus siRNA sense strand
aaaugaccacggaaaacccag

SEQ ID NO: 30736 - RNA, 21 nt, Artificial Sequence
  Marburg virus siRNA sense strand
aaugaccacggaaaacccagc

SEQ ID NO: 30737 - RNA, 21 nt, Artificial Sequence
  Marburg virus siRNA sense strand
augaccacggaaaacccagca

SEQ ID NO: 30738 - RNA, 21 nt, Artificial Sequence
  Marburg virus siRNA sense strand
ugaccacggaaaacccagcag

SEQ ID NO: 30739 - RNA, 21 nt, Artificial Sequence
  Marburg virus siRNA sense strand
gaccacggaaaacccagcagu

SEQ ID NO: 30740 - RNA, 21 nt, Artificial Sequence
  Marburg virus siRNA sense strand
accacggaaaacccagcagua

SEQ ID NO: 30741 - RNA, 21 nt, Artificial Sequence
  Marburg virus siRNA sense strand
ccacggaaaacccagcaguau

SEQ ID NO: 30742 - RNA, 21 nt, Artificial Sequence
  Marburg virus siRNA sense strand
cacggaaaacccagcaguauu

SEQ ID NO: 30743 - RNA, 21 nt, Artificial Sequence
  Marburg virus siRNA sense strand
acggaaaacccagcaguauug

SEQ ID NO: 30744 - RNA, 21 nt, Artificial Sequence
  Marburg virus siRNA sense strand
cggaaaacccagcaguauuga

SEQ ID NO: 30745 - RNA, 21 nt, Artificial Sequence
  Marburg virus siRNA sense strand
ggaaaacccagcaguauugaa

SEQ ID NO: 30746 - RNA, 21 nt, Artificial Sequence
  Marburg virus siRNA sense strand
gaaaacccagcaguauugaaa

SEQ ID NO: 30747 - RNA, 21 nt, Artificial Sequence
  Marburg virus siRNA sense strand
aaaacccagcaguauugaaau

SEQ ID NO: 30748 - RNA, 21 nt, Artificial Sequence
  Marburg virus siRNA sense strand
aaacccagcaguauugaaaua

SEQ ID NO: 30749 - RNA, 21 nt, Artificial Sequence
  Marburg virus siRNA sense strand
aacccagcaguauugaaauaa

SEQ ID NO: 30750 - RNA, 21 nt, Artificial Sequence
  Marburg virus siRNA sense strand
acccagcaguauugaaauaaa

SEQ ID NO: 30751 - RNA, 21 nt, Artificial Sequence
  Marburg virus siRNA sense strand
cccagcaguauugaaauaaag

SEQ ID NO: 30752 - RNA, 21 nt, Artificial Sequence
  Marburg virus siRNA sense strand
ccagcaguauugaaauaaagu

SEQ ID NO: 30753 - RNA, 21 nt, Artificial Sequence
  Marburg virus siRNA sense strand
cagcaguauugaaauaaaguu

SEQ ID NO: 30754 - RNA, 21 nt, Artificial Sequence
  Marburg virus siRNA sense strand
agcaguauugaaauaaaguua

SEQ ID NO: 30755 - RNA, 21 nt, Artificial Sequence
  Marburg virus siRNA sense strand
gcaguauugaaauaaaguuaa

SEQ ID NO: 30756 - RNA, 21 nt, Artificial Sequence
  Marburg virus siRNA sense strand
caguauugaaauaaaguuaac

SEQ ID NO: 30757 - RNA, 21 nt, Artificial Sequence
  Marburg virus siRNA sense strand
aguauugaaauaaaguuaacu

SEQ ID NO: 30758 - RNA, 21 nt, Artificial Sequence
  Marburg virus siRNA sense strand
guauugaaauaaaguuaacug

SEQ ID NO: 30759 - RNA, 21 nt, Artificial Sequence
  Marburg virus siRNA sense strand
uauugaaauaaaguuaacugg

SEQ ID NO: 30760 - RNA, 21 nt, Artificial Sequence
  Marburg virus siRNA sense strand
auugaaauaaaguuaacugga

SEQ ID NO: 30761 - RNA, 21 nt, Artificial Sequence
  Marburg virus siRNA sense strand
uugaaauaaaguuaacuggac

SEQ ID NO: 30762 - RNA, 21 nt, Artificial Sequence
  Marburg virus siRNA sense strand
ugaaauaaaguuaacuggaca

SEQ ID NO: 30763 - RNA, 21 nt, Artificial Sequence
  Marburg virus siRNA sense strand
gaaauaaaguuaacuggacaa

SEQ ID NO: 30764 - RNA, 21 nt, Artificial Sequence
  Marburg virus siRNA sense strand
aaauaaaguuaacuggacaac

SEQ ID NO: 30765 - RNA, 21 nt, Artificial Sequence
  Marburg virus siRNA sense strand
aauaaaguuaacuggacaaca

SEQ ID NO: 30766 - RNA, 21 nt, Artificial Sequence
  Marburg virus siRNA sense strand
auaaaguuaacuggacaacag

SEQ ID NO: 30767 - RNA, 21 nt, Artificial Sequence
  Marburg virus siRNA sense strand
uaaaguuaacuggacaacaga

SEQ ID NO: 30768 - RNA, 21 nt, Artificial Sequence
  Marburg virus siRNA sense strand
aaaguuaacuggacaacagau

SEQ ID NO: 30769 - RNA, 21 nt, Artificial Sequence
  Marburg virus siRNA sense strand
aaguuaacuggacaacagauc

SEQ ID NO: 30770 - RNA, 21 nt, Artificial Sequence
  Marburg virus siRNA sense strand
aguuaacuggacaacagauca

SEQ ID NO: 30771 - RNA, 21 nt, Artificial Sequence
  Marburg virus siRNA sense strand
guuaacuggacaacagaucau

SEQ ID NO: 30772 - RNA, 21 nt, Artificial Sequence
  Marburg virus siRNA sense strand
uuaacuggacaacagaucauu

SEQ ID NO: 30773 - RNA, 21 nt, Artificial Sequence
  Marburg virus siRNA sense strand
uaacuggacaacagaucauua

SEQ ID NO: 30774 - RNA, 21 nt, Artificial Sequence
  Marburg virus siRNA sense strand
aacuggacaacagaucauuau

SEQ ID NO: 30775 - RNA, 21 nt, Artificial Sequence
  Marburg virus siRNA sense strand
acuggacaacagaucauuauc

SEQ ID NO: 30776 - RNA, 21 nt, Artificial Sequence
  Marburg virus siRNA sense strand
cuggacaacagaucauuauca

SEQ ID NO: 30777 - RNA, 21 nt, Artificial Sequence
  Marburg virus siRNA sense strand
uggacaacagaucauuaucac

SEQ ID NO: 30778 - RNA, 21 nt, Artificial Sequence
  Marburg virus siRNA sense strand
ggacaacagaucauuaucacu

SEQ ID NO: 30779 - RNA, 21 nt, Artificial Sequence
  Marburg virus siRNA sense strand
gacaacagaucauuaucacuc

SEQ ID NO: 30780 - RNA, 21 nt, Artificial Sequence
  Marburg virus siRNA sense strand
acaacagaucauuaucacucg

SEQ ID NO: 30781 - RNA, 21 nt, Artificial Sequence
  Marburg virus siRNA sense strand
caacagaucauuaucacucgu

SEQ ID NO: 30782 - RNA, 21 nt, Artificial Sequence
  Marburg virus siRNA sense strand
aacagaucauuaucacucgug

SEQ ID NO: 30783 - RNA, 21 nt, Artificial Sequence
  Marburg virus siRNA sense strand
acagaucauuaucacucgugu

SEQ ID NO: 30784 - RNA, 21 nt, Artificial Sequence
  Marburg virus siRNA sense strand
cagaucauuaucacucguguu

SEQ ID NO: 30785 - RNA, 21 nt, Artificial Sequence
  Marburg virus siRNA sense strand
agaucauuaucacucguguua

SEQ ID NO: 30786 - RNA, 21 nt, Artificial Sequence
  Marburg virus siRNA sense strand
gaucauuaucacucguguuaa

SEQ ID NO: 30787 - RNA, 21 nt, Artificial Sequence
  Marburg virus siRNA sense strand
aucauuaucacucguguuaau

SEQ ID NO: 30788 - RNA, 21 nt, Artificial Sequence
  Marburg virus siRNA sense strand
ucauuaucacucguguuaaua

SEQ ID NO: 30789 - RNA, 21 nt, Artificial Sequence
  Marburg virus siRNA sense strand
cauuaucacucguguuaauau

SEQ ID NO: 30790 - RNA, 21 nt, Artificial Sequence
  Marburg virus siRNA sense strand
auuaucacucguguuaauaug

SEQ ID NO: 30791 - RNA, 21 nt, Artificial Sequence
  Marburg virus siRNA sense strand
uuaucacucguguuaauaugg

SEQ ID NO: 30792 - RNA, 21 nt, Artificial Sequence
  Marburg virus siRNA sense strand
uaucacucguguuaauauggg

SEQ ID NO: 30793 - RNA, 21 nt, Artificial Sequence
  Marburg virus siRNA sense strand
aucacucguguuaauaugggg

SEQ ID NO: 30794 - RNA, 21 nt, Artificial Sequence
  Marburg virus siRNA sense strand
ucacucguguuaauauggggu

SEQ ID NO: 30795 - RNA, 21 nt, Artificial Sequence
  Marburg virus siRNA sense strand
cacucguguuaauaugggguu

SEQ ID NO: 30796 - RNA, 21 nt, Artificial Sequence
  Marburg virus siRNA sense strand
acucguguuaauaugggguuu

SEQ ID NO: 30797 - RNA, 21 nt, Artificial Sequence
  Marburg virus siRNA sense strand
cucguguuaauaugggguuuc

SEQ ID NO: 30798 - RNA, 21 nt, Artificial Sequence
  Marburg virus siRNA sense strand
ucguguuaauaugggguuucu

SEQ ID NO: 30799 - RNA, 21 nt, Artificial Sequence
  Marburg virus siRNA sense strand
cguguuaauaugggguuucua

SEQ ID NO: 30800 - RNA, 21 nt, Artificial Sequence
  Marburg virus siRNA sense strand
guguuaauaugggguuucuag

SEQ ID NO: 30801 - RNA, 21 nt, Artificial Sequence
  Marburg virus siRNA sense strand
uguuaauaugggguuucuagu

SEQ ID NO: 30802 - RNA, 21 nt, Artificial Sequence
  Marburg virus siRNA sense strand
guuaauaugggguuucuagug

SEQ ID NO: 30803 - RNA, 21 nt, Artificial Sequence
  Marburg virus siRNA sense strand
uuaauaugggguuucuagugg

SEQ ID NO: 30804 - RNA, 21 nt, Artificial Sequence
  Marburg virus siRNA sense strand
uaauaugggguuucuagugga

SEQ ID NO: 30805 - RNA, 21 nt, Artificial Sequence
  Marburg virus siRNA sense strand
aauaugggguuucuaguggaa

SEQ ID NO: 30806 - RNA, 21 nt, Artificial Sequence
  Marburg virus siRNA sense strand
auaugggguuucuaguggaag

SEQ ID NO: 30807 - RNA, 21 nt, Artificial Sequence
  Marburg virus siRNA sense strand
uaugggguuucuaguggaagu

SEQ ID NO: 30808 - RNA, 21 nt, Artificial Sequence
  Marburg virus siRNA sense strand
augggguuucuaguggaaguc

SEQ ID NO: 30809 - RNA, 21 nt, Artificial Sequence
  Marburg virus siRNA sense strand
ugggguuucuaguggaaguca

SEQ ID NO: 30810 - RNA, 21 nt, Artificial Sequence
  Marburg virus siRNA sense strand
gggguuucuaguggaagucag

SEQ ID NO: 30811 - RNA, 21 nt, Artificial Sequence
  Marburg virus siRNA sense strand
ggguuucuaguggaagucagg

SEQ ID NO: 30812 - RNA, 21 nt, Artificial Sequence
  Marburg virus siRNA sense strand
gguuucuaguggaagucagga

SEQ ID NO: 30813 - RNA, 21 nt, Artificial Sequence
  Marburg virus siRNA sense strand
guuucuaguggaagucaggag

SEQ ID NO: 30814 - RNA, 21 nt, Artificial Sequence
  Marburg virus siRNA sense strand
uuucuaguggaagucaggagg

SEQ ID NO: 30815 - RNA, 21 nt, Artificial Sequence
  Marburg virus siRNA sense strand
uucuaguggaagucaggagga

SEQ ID NO: 30816 - RNA, 21 nt, Artificial Sequence
  Marburg virus siRNA sense strand
ucuaguggaagucaggaggau

SEQ ID NO: 30817 - RNA, 21 nt, Artificial Sequence
  Marburg virus siRNA sense strand
cuaguggaagucaggaggauu

SEQ ID NO: 30818 - RNA, 21 nt, Artificial Sequence
  Marburg virus siRNA sense strand
uaguggaagucaggaggauug

SEQ ID NO: 30819 - RNA, 21 nt, Artificial Sequence
  Marburg virus siRNA sense strand
aguggaagucaggaggauuga

SEQ ID NO: 30820 - RNA, 21 nt, Artificial Sequence
  Marburg virus siRNA sense strand
guggaagucaggaggauugau

SEQ ID NO: 30821 - RNA, 21 nt, Artificial Sequence
  Marburg virus siRNA sense strand
uggaagucaggaggauugaua

SEQ ID NO: 30822 - RNA, 21 nt, Artificial Sequence
  Marburg virus siRNA sense strand
ggaagucaggaggauugauau

SEQ ID NO: 30823 - RNA, 21 nt, Artificial Sequence
  Marburg virus siRNA sense strand
gaagucaggaggauugauauu

SEQ ID NO: 30824 - RNA, 21 nt, Artificial Sequence
  Marburg virus siRNA sense strand
aagucaggaggauugauauug

SEQ ID NO: 30825 - RNA, 21 nt, Artificial Sequence
  Marburg virus siRNA sense strand
agucaggaggauugauauuga

SEQ ID NO: 30826 - RNA, 21 nt, Artificial Sequence
  Marburg virus siRNA sense strand
gucaggaggauugauauugaa

SEQ ID NO: 30827 - RNA, 21 nt, Artificial Sequence
  Marburg virus siRNA sense strand
ucaggaggauugauauugaac

SEQ ID NO: 30828 - RNA, 21 nt, Artificial Sequence
  Marburg virus siRNA sense strand
caggaggauugauauugaacc

SEQ ID NO: 30829 - RNA, 21 nt, Artificial Sequence
  Marburg virus siRNA sense strand
aggaggauugauauugaaccu

SEQ ID NO: 30830 - RNA, 21 nt, Artificial Sequence
  Marburg virus siRNA sense strand
ggaggauugauauugaaccuu

SEQ ID NO: 30831 - RNA, 21 nt, Artificial Sequence
  Marburg virus siRNA sense strand
gaggauugauauugaaccuug

SEQ ID NO: 30832 - RNA, 21 nt, Artificial Sequence
  Marburg virus siRNA sense strand
aggauugauauugaaccuugu

SEQ ID NO: 30833 - RNA, 21 nt, Artificial Sequence
  Marburg virus siRNA sense strand
ggauugauauugaaccuuguu

SEQ ID NO: 30834 - RNA, 21 nt, Artificial Sequence
  Marburg virus siRNA sense strand
gauugauauugaaccuuguug

SEQ ID NO: 30835 - RNA, 21 nt, Artificial Sequence
  Marburg virus siRNA sense strand
auugauauugaaccuuguugu

SEQ ID NO: 30836 - RNA, 21 nt, Artificial Sequence
  Marburg virus siRNA sense strand
uugauauugaaccuuguugug

SEQ ID NO: 30837 - RNA, 21 nt, Artificial Sequence
  Marburg virus siRNA sense strand
ugauauugaaccuuguugugg

SEQ ID NO: 30838 - RNA, 21 nt, Artificial Sequence
  Marburg virus siRNA sense strand
gauauugaaccuuguuguggu

SEQ ID NO: 30839 - RNA, 21 nt, Artificial Sequence
  Marburg virus siRNA sense strand
auauugaaccuuguuguggug

SEQ ID NO: 30840 - RNA, 21 nt, Artificial Sequence
  Marburg virus siRNA sense strand
uauugaaccuuguugugguga

SEQ ID NO: 30841 - RNA, 21 nt, Artificial Sequence
  Marburg virus siRNA sense strand
auugaaccuuguuguggugag

SEQ ID NO: 30842 - RNA, 21 nt, Artificial Sequence
  Marburg virus siRNA sense strand
uugaaccuuguuguggugaga

SEQ ID NO: 30843 - RNA, 21 nt, Artificial Sequence
  Marburg virus siRNA sense strand
ugaaccuuguuguggugagac

SEQ ID NO: 30844 - RNA, 21 nt, Artificial Sequence
  Marburg virus siRNA sense strand
gaaccuuguuguggugagaca

SEQ ID NO: 30845 - RNA, 21 nt, Artificial Sequence
  Marburg virus siRNA sense strand
aaccuuguuguggugagacag

SEQ ID NO: 30846 - RNA, 21 nt, Artificial Sequence
  Marburg virus siRNA sense strand
accuuguuguggugagacagu

SEQ ID NO: 30847 - RNA, 21 nt, Artificial Sequence
  Marburg virus siRNA sense strand
ccuuguuguggugagacaguc

SEQ ID NO: 30848 - RNA, 21 nt, Artificial Sequence
  Marburg virus siRNA sense strand
cuuguuguggugagacagucc

SEQ ID NO: 30849 - RNA, 21 nt, Artificial Sequence
  Marburg virus siRNA sense strand
uuguuguggugagacaguccu

SEQ ID NO: 30850 - RNA, 21 nt, Artificial Sequence
  Marburg virus siRNA sense strand
uguuguggugagacaguccuc

SEQ ID NO: 30851 - RNA, 21 nt, Artificial Sequence
  Marburg virus siRNA sense strand
guuguggugagacaguccucu

SEQ ID NO: 30852 - RNA, 21 nt, Artificial Sequence
  Marburg virus siRNA sense strand
uuguggugagacaguccucuc

SEQ ID NO: 30853 - RNA, 21 nt, Artificial Sequence
  Marburg virus siRNA sense strand
uguggugagacaguccucuca

SEQ ID NO: 30854 - RNA, 21 nt, Artificial Sequence
  Marburg virus siRNA sense strand
guggugagacaguccucucag

SEQ ID NO: 30855 - RNA, 21 nt, Artificial Sequence
  Marburg virus siRNA sense strand
uggugagacaguccucucaga

SEQ ID NO: 30856 - RNA, 21 nt, Artificial Sequence
  Marburg virus siRNA sense strand
ggugagacaguccucucagaa

SEQ ID NO: 30857 - RNA, 21 nt, Artificial Sequence
  Marburg virus siRNA sense strand
gugagacaguccucucagaau

SEQ ID NO: 30858 - RNA, 21 nt, Artificial Sequence
  Marburg virus siRNA sense strand
ugagacaguccucucagaauc

SEQ ID NO: 30859 - RNA, 21 nt, Artificial Sequence
  Marburg virus siRNA sense strand
gagacaguccucucagaauca

SEQ ID NO: 30860 - RNA, 21 nt, Artificial Sequence
  Marburg virus siRNA sense strand
agacaguccucucagaaucag

SEQ ID NO: 30861 - RNA, 21 nt, Artificial Sequence
  Marburg virus siRNA sense strand
gacaguccucucagaaucagu

SEQ ID NO: 30862 - RNA, 21 nt, Artificial Sequence
  Marburg virus siRNA sense strand
acaguccucucagaaucaguu

SEQ ID NO: 30863 - RNA, 21 nt, Artificial Sequence
  Marburg virus siRNA sense strand
caguccucucagaaucaguug

SEQ ID NO: 30864 - RNA, 21 nt, Artificial Sequence
  Marburg virus siRNA sense strand
aguccucucagaaucaguugu

SEQ ID NO: 30865 - RNA, 21 nt, Artificial Sequence
  Marburg virus siRNA sense strand
guccucucagaaucaguuguu

SEQ ID NO: 30866 - RNA, 21 nt, Artificial Sequence
  Marburg virus siRNA sense strand
uccucucagaaucaguuguuu

SEQ ID NO: 30867 - RNA, 21 nt, Artificial Sequence
  Marburg virus siRNA sense strand
ccucucagaaucaguuguuuu

SEQ ID NO: 30868 - RNA, 21 nt, Artificial Sequence
  Marburg virus siRNA sense strand
cucucagaaucaguuguuuuu

SEQ ID NO: 30869 - RNA, 21 nt, Artificial Sequence
  Marburg virus siRNA sense strand
ucucagaaucaguuguuuuug

SEQ ID NO: 30870 - RNA, 21 nt, Artificial Sequence
  Marburg virus siRNA sense strand
cucagaaucaguuguuuuugg

SEQ ID NO: 30871 - RNA, 21 nt, Artificial Sequence
  Marburg virus siRNA sense strand
ucagaaucaguuguuuuuggg

SEQ ID NO: 30872 - RNA, 21 nt, Artificial Sequence
  Marburg virus siRNA sense strand
cagaaucaguuguuuuugggc

SEQ ID NO: 30873 - RNA, 21 nt, Artificial Sequence
  Marburg virus siRNA sense strand
agaaucaguuguuuuugggcu

SEQ ID NO: 30874 - RNA, 21 nt, Artificial Sequence
  Marburg virus siRNA sense strand
gaaucaguuguuuuugggcua

SEQ ID NO: 30875 - RNA, 21 nt, Artificial Sequence
  Marburg virus siRNA sense strand
aaucaguuguuuuugggcuag

SEQ ID NO: 30876 - RNA, 21 nt, Artificial Sequence
  Marburg virus siRNA sense strand
aucaguuguuuuugggcuagu

SEQ ID NO: 30877 - RNA, 21 nt, Artificial Sequence
  Marburg virus siRNA sense strand
ucaguuguuuuugggcuagug

SEQ ID NO: 30878 - RNA, 21 nt, Artificial Sequence
  Marburg virus siRNA sense strand
caguuguuuuugggcuagugg

SEQ ID NO: 30879 - RNA, 21 nt, Artificial Sequence
  Marburg virus siRNA sense strand
aguuguuuuugggcuaguggc

SEQ ID NO: 30880 - RNA, 21 nt, Artificial Sequence
  Marburg virus siRNA sense strand
guuguuuuugggcuaguggcu

SEQ ID NO: 30881 - RNA, 21 nt, Artificial Sequence
  Marburg virus siRNA sense strand
uuguuuuugggcuaguggcug

SEQ ID NO: 30882 - RNA, 21 nt, Artificial Sequence
  Marburg virus siRNA sense strand
uguuuuugggcuaguggcuga

SEQ ID NO: 30883 - RNA, 21 nt, Artificial Sequence
  Marburg virus siRNA sense strand
guuuuugggcuaguggcugag

SEQ ID NO: 30884 - RNA, 21 nt, Artificial Sequence
  Marburg virus siRNA sense strand
uuuuugggcuaguggcugagg

SEQ ID NO: 30885 - RNA, 21 nt, Artificial Sequence
  Marburg virus siRNA sense strand
uuuugggcuaguggcugaggc

SEQ ID NO: 30886 - RNA, 21 nt, Artificial Sequence
  Marburg virus siRNA sense strand
uuugggcuaguggcugaggca

SEQ ID NO: 30887 - RNA, 21 nt, Artificial Sequence
  Marburg virus siRNA sense strand
uugggcuaguggcugaggcag

SEQ ID NO: 30888 - RNA, 21 nt, Artificial Sequence
  Marburg virus siRNA sense strand
ugggcuaguggcugaggcagu

SEQ ID NO: 30889 - RNA, 21 nt, Artificial Sequence
  Marburg virus siRNA sense strand
gggcuaguggcugaggcaguu

SEQ ID NO: 30890 - RNA, 21 nt, Artificial Sequence
  Marburg virus siRNA sense strand
ggcuaguggcugaggcaguuc

SEQ ID NO: 30891 - RNA, 21 nt, Artificial Sequence
  Marburg virus siRNA sense strand
gcuaguggcugaggcaguucu

SEQ ID NO: 30892 - RNA, 21 nt, Artificial Sequence
  Marburg virus siRNA sense strand
cuaguggcugaggcaguucua

SEQ ID NO: 30893 - RNA, 21 nt, Artificial Sequence
  Marburg virus siRNA sense strand
uaguggcugaggcaguucuaa

SEQ ID NO: 30894 - RNA, 21 nt, Artificial Sequence
  Marburg virus siRNA sense strand
aguggcugaggcaguucuaag

SEQ ID NO: 30895 - RNA, 21 nt, Artificial Sequence
  Marburg virus siRNA sense strand
guggcugaggcaguucuaaga

SEQ ID NO: 30896 - RNA, 21 nt, Artificial Sequence
  Marburg virus siRNA sense strand
uggcugaggcaguucuaagag

SEQ ID NO: 30897 - RNA, 21 nt, Artificial Sequence
  Marburg virus siRNA sense strand
ggcugaggcaguucuaagaga

SEQ ID NO: 30898 - RNA, 21 nt, Artificial Sequence
  Marburg virus siRNA sense strand
gcugaggcaguucuaagagaa

SEQ ID NO: 30899 - RNA, 21 nt, Artificial Sequence
  Marburg virus siRNA sense strand
cugaggcaguucuaagagaac

SEQ ID NO: 30900 - RNA, 21 nt, Artificial Sequence
  Marburg virus siRNA sense strand
ugaggcaguucuaagagaaca

SEQ ID NO: 30901 - RNA, 21 nt, Artificial Sequence
  Marburg virus siRNA sense strand
gaggcaguucuaagagaacac

SEQ ID NO: 30902 - RNA, 21 nt, Artificial Sequence
  Marburg virus siRNA sense strand
aggcaguucuaagagaacaca

SEQ ID NO: 30903 - RNA, 21 nt, Artificial Sequence
  Marburg virus siRNA sense strand
ggcaguucuaagagaacacag

SEQ ID NO: 30904 - RNA, 21 nt, Artificial Sequence
  Marburg virus siRNA sense strand
gcaguucuaagagaacacagu

SEQ ID NO: 30905 - RNA, 21 nt, Artificial Sequence
  Marburg virus siRNA sense strand
caguucuaagagaacacaguc

SEQ ID NO: 30906 - RNA, 21 nt, Artificial Sequence
  Marburg virus siRNA sense strand
aguucuaagagaacacaguca

SEQ ID NO: 30907 - RNA, 21 nt, Artificial Sequence
  Marburg virus siRNA sense strand
guucuaagagaacacagucaa

SEQ ID NO: 30908 - RNA, 21 nt, Artificial Sequence
  Marburg virus siRNA sense strand
uucuaagagaacacagucaaa

SEQ ID NO: 30909 - RNA, 21 nt, Artificial Sequence
  Marburg virus siRNA sense strand
ucuaagagaacacagucaaau

SEQ ID NO: 30910 - RNA, 21 nt, Artificial Sequence
  Marburg virus siRNA sense strand
cuaagagaacacagucaaaug

SEQ ID NO: 30911 - RNA, 21 nt, Artificial Sequence
  Marburg virus siRNA sense strand
uaagagaacacagucaaaugg

SEQ ID NO: 30912 - RNA, 21 nt, Artificial Sequence
  Marburg virus siRNA sense strand
aagagaacacagucaaaugga

SEQ ID NO: 30913 - RNA, 21 nt, Artificial Sequence
  Marburg virus siRNA sense strand
agagaacacagucaaauggag

SEQ ID NO: 30914 - RNA, 21 nt, Artificial Sequence
  Marburg virus siRNA sense strand
gagaacacagucaaauggaga

SEQ ID NO: 30915 - RNA, 21 nt, Artificial Sequence
  Marburg virus siRNA sense strand
agaacacagucaaauggagaa

SEQ ID NO: 30916 - RNA, 21 nt, Artificial Sequence
  Marburg virus siRNA sense strand
gaacacagucaaauggagaag

SEQ ID NO: 30917 - RNA, 21 nt, Artificial Sequence
  Marburg virus siRNA sense strand
aacacagucaaauggagaagg

SEQ ID NO: 30918 - RNA, 21 nt, Artificial Sequence
  Marburg virus siRNA sense strand
acacagucaaauggagaaggg

SEQ ID NO: 30919 - RNA, 21 nt, Artificial Sequence
  Marburg virus siRNA sense strand
cacagucaaauggagaagggc

SEQ ID NO: 30920 - RNA, 21 nt, Artificial Sequence
  Marburg virus siRNA sense strand
acagucaaauggagaagggcc

SEQ ID NO: 30921 - RNA, 21 nt, Artificial Sequence
  Marburg virus siRNA sense strand
cagucaaauggagaagggcca

SEQ ID NO: 30922 - RNA, 21 nt, Artificial Sequence
  Marburg virus siRNA sense strand
agucaaauggagaagggccaa

SEQ ID NO: 30923 - RNA, 21 nt, Artificial Sequence
  Marburg virus siRNA sense strand
gucaaauggagaagggccaac

SEQ ID NO: 30924 - RNA, 21 nt, Artificial Sequence
  Marburg virus siRNA sense strand
ucaaauggagaagggccaacc

SEQ ID NO: 30925 - RNA, 21 nt, Artificial Sequence
  Marburg virus siRNA sense strand
caaauggagaagggccaaccc

SEQ ID NO: 30926 - RNA, 21 nt, Artificial Sequence
  Marburg virus siRNA sense strand
aaauggagaagggccaacccc

SEQ ID NO: 30927 - RNA, 21 nt, Artificial Sequence
  Marburg virus siRNA sense strand
aauggagaagggccaaccccu

SEQ ID NO: 30928 - RNA, 21 nt, Artificial Sequence
  Marburg virus siRNA sense strand
auggagaagggccaaccccuc

SEQ ID NO: 30929 - RNA, 21 nt, Artificial Sequence
  Marburg virus siRNA sense strand
uggagaagggccaaccccucg

SEQ ID NO: 30930 - RNA, 21 nt, Artificial Sequence
  Marburg virus siRNA sense strand
ggagaagggccaaccccucga

SEQ ID NO: 30931 - RNA, 21 nt, Artificial Sequence
  Marburg virus siRNA sense strand
gagaagggccaaccccucgau

SEQ ID NO: 30932 - RNA, 21 nt, Artificial Sequence
  Marburg virus siRNA sense strand
agaagggccaaccccucgauc

SEQ ID NO: 30933 - RNA, 21 nt, Artificial Sequence
  Marburg virus siRNA sense strand
gaagggccaaccccucgaucu

SEQ ID NO: 30934 - RNA, 21 nt, Artificial Sequence
  Marburg virus siRNA sense strand
aagggccaaccccucgaucug

SEQ ID NO: 30935 - RNA, 21 nt, Artificial Sequence
  Marburg virus siRNA sense strand
agggccaaccccucgaucuga

SEQ ID NO: 30936 - RNA, 21 nt, Artificial Sequence
  Marburg virus siRNA sense strand
gggccaaccccucgaucugac

SEQ ID NO: 30937 - RNA, 21 nt, Artificial Sequence
  Marburg virus siRNA sense strand
ggccaaccccucgaucugaca

SEQ ID NO: 30938 - RNA, 21 nt, Artificial Sequence
  Marburg virus siRNA sense strand
gccaaccccucgaucugacac

SEQ ID NO: 30939 - RNA, 21 nt, Artificial Sequence
  Marburg virus siRNA sense strand
ccaaccccucgaucugacaca

SEQ ID NO: 30940 - RNA, 21 nt, Artificial Sequence
  Marburg virus siRNA sense strand
caaccccucgaucugacacaa

SEQ ID NO: 30941 - RNA, 21 nt, Artificial Sequence
  Marburg virus siRNA sense strand
aaccccucgaucugacacaau

SEQ ID NO: 30942 - RNA, 21 nt, Artificial Sequence
  Marburg virus siRNA sense strand
accccucgaucugacacaaua

SEQ ID NO: 30943 - RNA, 21 nt, Artificial Sequence
  Marburg virus siRNA sense strand
ccccucgaucugacacaauac

SEQ ID NO: 30944 - RNA, 21 nt, Artificial Sequence
  Marburg virus siRNA sense strand
cccucgaucugacacaauaca

SEQ ID NO: 30945 - RNA, 21 nt, Artificial Sequence
  Marburg virus siRNA sense strand
ccucgaucugacacaauacau

SEQ ID NO: 30946 - RNA, 21 nt, Artificial Sequence
  Marburg virus siRNA sense strand
cucgaucugacacaauacaug

SEQ ID NO: 30947 - RNA, 21 nt, Artificial Sequence
  Marburg virus siRNA sense strand
ucgaucugacacaauacauga

SEQ ID NO: 30948 - RNA, 21 nt, Artificial Sequence
  Marburg virus siRNA sense strand
cgaucugacacaauacaugaa

SEQ ID NO: 30949 - RNA, 21 nt, Artificial Sequence
  Marburg virus siRNA sense strand
gaucugacacaauacaugaac

SEQ ID NO: 30950 - RNA, 21 nt, Artificial Sequence
  Marburg virus siRNA sense strand
aucugacacaauacaugaaca

SEQ ID NO: 30951 - RNA, 21 nt, Artificial Sequence
  Marburg virus siRNA sense strand
ucugacacaauacaugaacag

SEQ ID NO: 30952 - RNA, 21 nt, Artificial Sequence
  Marburg virus siRNA sense strand
cugacacaauacaugaacagc

SEQ ID NO: 30953 - RNA, 21 nt, Artificial Sequence
  Marburg virus siRNA sense strand
ugacacaauacaugaacagca

SEQ ID NO: 30954 - RNA, 21 nt, Artificial Sequence
  Marburg virus siRNA sense strand
gacacaauacaugaacagcaa

SEQ ID NO: 30955 - RNA, 21 nt, Artificial Sequence
  Marburg virus siRNA sense strand
acacaauacaugaacagcaaa

SEQ ID NO: 30956 - RNA, 21 nt, Artificial Sequence
  Marburg virus siRNA sense strand
cacaauacaugaacagcaaaa

SEQ ID NO: 30957 - RNA, 21 nt, Artificial Sequence
  Marburg virus siRNA sense strand
acaauacaugaacagcaaaau

SEQ ID NO: 30958 - RNA, 21 nt, Artificial Sequence
  Marburg virus siRNA sense strand
caauacaugaacagcaaaauu

SEQ ID NO: 30959 - RNA, 21 nt, Artificial Sequence
  Marburg virus siRNA sense strand
aauacaugaacagcaaaauug

SEQ ID NO: 30960 - RNA, 21 nt, Artificial Sequence
  Marburg virus siRNA sense strand
auacaugaacagcaaaauugc

SEQ ID NO: 30961 - RNA, 21 nt, Artificial Sequence
  Marburg virus siRNA sense strand
uacaugaacagcaaaauugcu

SEQ ID NO: 30962 - RNA, 21 nt, Artificial Sequence
  Marburg virus siRNA sense strand
acaugaacagcaaaauugcua

SEQ ID NO: 30963 - RNA, 21 nt, Artificial Sequence
  Marburg virus siRNA sense strand
caugaacagcaaaauugcuau

SEQ ID NO: 30964 - RNA, 21 nt, Artificial Sequence
  Marburg virus siRNA sense strand
augaacagcaaaauugcuaua

SEQ ID NO: 30965 - RNA, 21 nt, Artificial Sequence
  Marburg virus siRNA sense strand
ugaacagcaaaauugcuauau

SEQ ID NO: 30966 - RNA, 21 nt, Artificial Sequence
  Marburg virus siRNA sense strand
gaacagcaaaauugcuauaua

SEQ ID NO: 30967 - RNA, 21 nt, Artificial Sequence
  Marburg virus siRNA sense strand
aacagcaaaauugcuauauaa

SEQ ID NO: 30968 - RNA, 21 nt, Artificial Sequence
  Marburg virus siRNA sense strand
acagcaaaauugcuauauaag

SEQ ID NO: 30969 - RNA, 21 nt, Artificial Sequence
  Marburg virus siRNA sense strand
cagcaaaauugcuauauaagu

SEQ ID NO: 30970 - RNA, 21 nt, Artificial Sequence
  Marburg virus siRNA sense strand
agcaaaauugcuauauaagug

SEQ ID NO: 30971 - RNA, 21 nt, Artificial Sequence
  Marburg virus siRNA sense strand
gcaaaauugcuauauaagugg

SEQ ID NO: 30972 - RNA, 21 nt, Artificial Sequence
  Marburg virus siRNA sense strand
caaaauugcuauauaaguggc

SEQ ID NO: 30973 - RNA, 21 nt, Artificial Sequence
  Marburg virus siRNA sense strand
aaaauugcuauauaaguggcu

SEQ ID NO: 30974 - RNA, 21 nt, Artificial Sequence
  Marburg virus siRNA sense strand
aaauugcuauauaaguggcuu

SEQ ID NO: 30975 - RNA, 21 nt, Artificial Sequence
  Marburg virus siRNA sense strand
aauugcuauauaaguggcuua

SEQ ID NO: 30976 - RNA, 21 nt, Artificial Sequence
  Marburg virus siRNA sense strand
auugcuauauaaguggcuuaa

SEQ ID NO: 30977 - RNA, 21 nt, Artificial Sequence
  Marburg virus siRNA sense strand
uugcuauauaaguggcuuaaa

SEQ ID NO: 30978 - RNA, 21 nt, Artificial Sequence
  Marburg virus siRNA sense strand
ugcuauauaaguggcuuaaau

SEQ ID NO: 30979 - RNA, 21 nt, Artificial Sequence
  Marburg virus siRNA sense strand
gcuauauaaguggcuuaaauu

SEQ ID NO: 30980 - RNA, 21 nt, Artificial Sequence
  Marburg virus siRNA sense strand
cuauauaaguggcuuaaauua

SEQ ID NO: 30981 - RNA, 21 nt, Artificial Sequence
  Marburg virus siRNA sense strand
uauauaaguggcuuaaauuag

SEQ ID NO: 30982 - RNA, 21 nt, Artificial Sequence
  Marburg virus siRNA sense strand
auauaaguggcuuaaauuagc

SEQ ID NO: 30983 - RNA, 21 nt, Artificial Sequence
  Marburg virus siRNA sense strand
uauaaguggcuuaaauuagca

SEQ ID NO: 30984 - RNA, 21 nt, Artificial Sequence
  Marburg virus siRNA sense strand
auaaguggcuuaaauuagcau

SEQ ID NO: 30985 - RNA, 21 nt, Artificial Sequence
  Marburg virus siRNA sense strand
uaaguggcuuaaauuagcaug

SEQ ID NO: 30986 - RNA, 21 nt, Artificial Sequence
  Marburg virus siRNA sense strand
aaguggcuuaaauuagcaugg

SEQ ID NO: 30987 - RNA, 21 nt, Artificial Sequence
  Marburg virus siRNA sense strand
aguggcuuaaauuagcaugga

SEQ ID NO: 30988 - RNA, 21 nt, Artificial Sequence
  Marburg virus siRNA sense strand
guggcuuaaauuagcauggau

SEQ ID NO: 30989 - RNA, 21 nt, Artificial Sequence
  Marburg virus siRNA sense strand
uggcuuaaauuagcauggaua

SEQ ID NO: 30990 - RNA, 21 nt, Artificial Sequence
  Marburg virus siRNA sense strand
ggcuuaaauuagcauggauau

SEQ ID NO: 30991 - RNA, 21 nt, Artificial Sequence
  Marburg virus siRNA sense strand
gcuuaaauuagcauggauauu

SEQ ID NO: 30992 - RNA, 21 nt, Artificial Sequence
  Marburg virus siRNA sense strand
cuuaaauuagcauggauauuc

SEQ ID NO: 30993 - RNA, 21 nt, Artificial Sequence
  Marburg virus siRNA sense strand
uuaaauuagcauggauauuca

SEQ ID NO: 30994 - RNA, 21 nt, Artificial Sequence
  Marburg virus siRNA sense strand
uaaauuagcauggauauucau

SEQ ID NO: 30995 - RNA, 21 nt, Artificial Sequence
  Marburg virus siRNA sense strand
aaauuagcauggauauucaua

SEQ ID NO: 30996 - RNA, 21 nt, Artificial Sequence
  Marburg virus siRNA sense strand
aauuagcauggauauucauag

SEQ ID NO: 30997 - RNA, 21 nt, Artificial Sequence
  Marburg virus siRNA sense strand
auuagcauggauauucauagu

SEQ ID NO: 30998 - RNA, 21 nt, Artificial Sequence
  Marburg virus siRNA sense strand
uuagcauggauauucauaguu

SEQ ID NO: 30999 - RNA, 21 nt, Artificial Sequence
  Marburg virus siRNA sense strand
uagcauggauauucauaguuu

SEQ ID NO: 31000 - RNA, 21 nt, Artificial Sequence
  Marburg virus siRNA sense strand
agcauggauauucauaguuua

SEQ ID NO: 31001 - RNA, 21 nt, Artificial Sequence
  Marburg virus siRNA sense strand
gcauggauauucauaguuuaa

SEQ ID NO: 31002 - RNA, 21 nt, Artificial Sequence
  Marburg virus siRNA sense strand
cauggauauucauaguuuaac

SEQ ID NO: 31003 - RNA, 21 nt, Artificial Sequence
  Marburg virus siRNA sense strand
auggauauucauaguuuaacc

SEQ ID NO: 31004 - RNA, 21 nt, Artificial Sequence
  Marburg virus siRNA sense strand
uggauauucauaguuuaacca

SEQ ID NO: 31005 - RNA, 21 nt, Artificial Sequence
  Marburg virus siRNA sense strand
ggauauucauaguuuaaccac

SEQ ID NO: 31006 - RNA, 21 nt, Artificial Sequence
  Marburg virus siRNA sense strand
gauauucauaguuuaaccaca

SEQ ID NO: 31007 - RNA, 21 nt, Artificial Sequence
  Marburg virus siRNA sense strand
auauucauaguuuaaccacau

SEQ ID NO: 31008 - RNA, 21 nt, Artificial Sequence
  Marburg virus siRNA sense strand
uauucauaguuuaaccacaua

SEQ ID NO: 31009 - RNA, 21 nt, Artificial Sequence
  Marburg virus siRNA sense strand
auucauaguuuaaccacauaa

SEQ ID NO: 31010 - RNA, 21 nt, Artificial Sequence
  Marburg virus siRNA sense strand
uucauaguuuaaccacauaau

SEQ ID NO: 31011 - RNA, 21 nt, Artificial Sequence
  Marburg virus siRNA sense strand
ucauaguuuaaccacauaaua

SEQ ID NO: 31012 - RNA, 21 nt, Artificial Sequence
  Marburg virus siRNA sense strand
cauaguuuaaccacauaauaa

SEQ ID NO: 31013 - RNA, 21 nt, Artificial Sequence
  Marburg virus siRNA sense strand
auaguuuaaccacauaauaau

SEQ ID NO: 31014 - RNA, 21 nt, Artificial Sequence
  Marburg virus siRNA sense strand
uaguuuaaccacauaauaaug

SEQ ID NO: 31015 - RNA, 21 nt, Artificial Sequence
  Marburg virus siRNA sense strand
aguuuaaccacauaauaaugu

SEQ ID NO: 31016 - RNA, 21 nt, Artificial Sequence
  Marburg virus siRNA sense strand
guuuaaccacauaauaauguu

SEQ ID NO: 31017 - RNA, 21 nt, Artificial Sequence
  Marburg virus siRNA sense strand
uuuaaccacauaauaauguug

SEQ ID NO: 31018 - RNA, 21 nt, Artificial Sequence
  Marburg virus siRNA sense strand
uuaaccacauaauaauguugg

SEQ ID NO: 31019 - RNA, 21 nt, Artificial Sequence
  Marburg virus siRNA sense strand
uaaccacauaauaauguugga

SEQ ID NO: 31020 - RNA, 21 nt, Artificial Sequence
  Marburg virus siRNA sense strand
aaccacauaauaauguuggag

SEQ ID NO: 31021 - RNA, 21 nt, Artificial Sequence
  Marburg virus siRNA sense strand
accacauaauaauguuggagg

SEQ ID NO: 31022 - RNA, 21 nt, Artificial Sequence
  Marburg virus siRNA sense strand
ccacauaauaauguuggaggc

SEQ ID NO: 31023 - RNA, 21 nt, Artificial Sequence
  Marburg virus siRNA sense strand
cacauaauaauguuggaggca

SEQ ID NO: 31024 - RNA, 21 nt, Artificial Sequence
  Marburg virus siRNA sense strand
acauaauaauguuggaggcac

SEQ ID NO: 31025 - RNA, 21 nt, Artificial Sequence
  Marburg virus siRNA sense strand
cauaauaauguuggaggcaca

SEQ ID NO: 31026 - RNA, 21 nt, Artificial Sequence
  Marburg virus siRNA sense strand
auaauaauguuggaggcacag

SEQ ID NO: 31027 - RNA, 21 nt, Artificial Sequence
  Marburg virus siRNA sense strand
uaauaauguuggaggcacagu

SEQ ID NO: 31028 - RNA, 21 nt, Artificial Sequence
  Marburg virus siRNA sense strand
aauaauguuggaggcacagua

SEQ ID NO: 31029 - RNA, 21 nt, Artificial Sequence
  Marburg virus siRNA sense strand
auaauguuggaggcacaguac

SEQ ID NO: 31030 - RNA, 21 nt, Artificial Sequence
  Marburg virus siRNA sense strand
uaauguuggaggcacaguaca

SEQ ID NO: 31031 - RNA, 21 nt, Artificial Sequence
  Marburg virus siRNA sense strand
aauguuggaggcacaguacau

SEQ ID NO: 31032 - RNA, 21 nt, Artificial Sequence
  Marburg virus siRNA sense strand
auguuggaggcacaguacauu

SEQ ID NO: 31033 - RNA, 21 nt, Artificial Sequence
  Marburg virus siRNA sense strand
uguuggaggcacaguacauua

SEQ ID NO: 31034 - RNA, 21 nt, Artificial Sequence
  Marburg virus siRNA sense strand
guuggaggcacaguacauuau

SEQ ID NO: 31035 - RNA, 21 nt, Artificial Sequence
  Marburg virus siRNA sense strand
uuggaggcacaguacauuaua

SEQ ID NO: 31036 - RNA, 21 nt, Artificial Sequence
  Marburg virus siRNA sense strand
uggaggcacaguacauuauag

SEQ ID NO: 31037 - RNA, 21 nt, Artificial Sequence
  Marburg virus siRNA sense strand
ggaggcacaguacauuauagu

SEQ ID NO: 31038 - RNA, 21 nt, Artificial Sequence
  Marburg virus siRNA sense strand
gaggcacaguacauuauaguu

SEQ ID NO: 31039 - RNA, 21 nt, Artificial Sequence
  Marburg virus siRNA sense strand
aggcacaguacauuauaguua

SEQ ID NO: 31040 - RNA, 21 nt, Artificial Sequence
  Marburg virus siRNA sense strand
ggcacaguacauuauaguuaa

SEQ ID NO: 31041 - RNA, 21 nt, Artificial Sequence
  Marburg virus siRNA sense strand
gcacaguacauuauaguuaau

SEQ ID NO: 31042 - RNA, 21 nt, Artificial Sequence
  Marburg virus siRNA sense strand
cacaguacauuauaguuaauu

SEQ ID NO: 31043 - RNA, 21 nt, Artificial Sequence
  Marburg virus siRNA sense strand
acaguacauuauaguuaauua

SEQ ID NO: 31044 - RNA, 21 nt, Artificial Sequence
  Marburg virus siRNA sense strand
caguacauuauaguuaauuau

SEQ ID NO: 31045 - RNA, 21 nt, Artificial Sequence
  Marburg virus siRNA sense strand
aguacauuauaguuaauuauc

SEQ ID NO: 31046 - RNA, 21 nt, Artificial Sequence
  Marburg virus siRNA sense strand
guacauuauaguuaauuaucc

SEQ ID NO: 31047 - RNA, 21 nt, Artificial Sequence
  Marburg virus siRNA sense strand
uacauuauaguuaauuauccu

SEQ ID NO: 31048 - RNA, 21 nt, Artificial Sequence
  Marburg virus siRNA sense strand
acauuauaguuaauuauccug

SEQ ID NO: 31049 - RNA, 21 nt, Artificial Sequence
  Marburg virus siRNA sense strand
cauuauaguuaauuauccugu

SEQ ID NO: 31050 - RNA, 21 nt, Artificial Sequence
  Marburg virus siRNA sense strand
auuauaguuaauuauccugua

SEQ ID NO: 31051 - RNA, 21 nt, Artificial Sequence
  Marburg virus siRNA sense strand
uuauaguuaauuauccuguau

SEQ ID NO: 31052 - RNA, 21 nt, Artificial Sequence
  Marburg virus siRNA sense strand
uauaguuaauuauccuguaua

SEQ ID NO: 31053 - RNA, 21 nt, Artificial Sequence
  Marburg virus siRNA sense strand
auaguuaauuauccuguauaa

SEQ ID NO: 31054 - RNA, 21 nt, Artificial Sequence
  Marburg virus siRNA sense strand
uaguuaauuauccuguauaac

SEQ ID NO: 31055 - RNA, 21 nt, Artificial Sequence
  Marburg virus siRNA sense strand
aguuaauuauccuguauaaca

SEQ ID NO: 31056 - RNA, 21 nt, Artificial Sequence
  Marburg virus siRNA sense strand
guuaauuauccuguauaacaa

SEQ ID NO: 31057 - RNA, 21 nt, Artificial Sequence
  Marburg virus siRNA sense strand
uuaauuauccuguauaacaaa

SEQ ID NO: 31058 - RNA, 21 nt, Artificial Sequence
  Marburg virus siRNA sense strand
uaauuauccuguauaacaaag

SEQ ID NO: 31059 - RNA, 21 nt, Artificial Sequence
  Marburg virus siRNA sense strand
aauuauccuguauaacaaaga

SEQ ID NO: 31060 - RNA, 21 nt, Artificial Sequence
  Marburg virus siRNA sense strand
auuauccuguauaacaaagaa

SEQ ID NO: 31061 - RNA, 21 nt, Artificial Sequence
  Marburg virus siRNA sense strand
uuauccuguauaacaaagaau

SEQ ID NO: 31062 - RNA, 21 nt, Artificial Sequence
  Marburg virus siRNA sense strand
uauccuguauaacaaagaaua

SEQ ID NO: 31063 - RNA, 21 nt, Artificial Sequence
  Marburg virus siRNA sense strand
auccuguauaacaaagaauau

SEQ ID NO: 31064 - RNA, 21 nt, Artificial Sequence
  Marburg virus siRNA sense strand
uccuguauaacaaagaauaua

SEQ ID NO: 31065 - RNA, 21 nt, Artificial Sequence
  Marburg virus siRNA sense strand
ccuguauaacaaagaauauac

SEQ ID NO: 31066 - RNA, 21 nt, Artificial Sequence
  Marburg virus siRNA sense strand
cuguauaacaaagaauauacc

SEQ ID NO: 31067 - RNA, 21 nt, Artificial Sequence
  Marburg virus siRNA sense strand
uguauaacaaagaauauaccu

SEQ ID NO: 31068 - RNA, 21 nt, Artificial Sequence
  Marburg virus siRNA sense strand
guauaacaaagaauauaccua

SEQ ID NO: 31069 - RNA, 21 nt, Artificial Sequence
  Marburg virus siRNA sense strand
uauaacaaagaauauaccuac

SEQ ID NO: 31070 - RNA, 21 nt, Artificial Sequence
  Marburg virus siRNA sense strand
auaacaaagaauauaccuacc

SEQ ID NO: 31071 - RNA, 21 nt, Artificial Sequence
  Marburg virus siRNA sense strand
uaacaaagaauauaccuaccc

SEQ ID NO: 31072 - RNA, 21 nt, Artificial Sequence
  Marburg virus siRNA sense strand
aacaaagaauauaccuacccu

SEQ ID NO: 31073 - RNA, 21 nt, Artificial Sequence
  Marburg virus siRNA sense strand
acaaagaauauaccuacccug

SEQ ID NO: 31074 - RNA, 21 nt, Artificial Sequence
  Marburg virus siRNA sense strand
caaagaauauaccuacccuga

SEQ ID NO: 31075 - RNA, 21 nt, Artificial Sequence
  Marburg virus siRNA sense strand
aaagaauauaccuacccugau

SEQ ID NO: 31076 - RNA, 21 nt, Artificial Sequence
  Marburg virus siRNA sense strand
aagaauauaccuacccugauu

SEQ ID NO: 31077 - RNA, 21 nt, Artificial Sequence
  Marburg virus siRNA sense strand
agaauauaccuacccugauuu

SEQ ID NO: 31078 - RNA, 21 nt, Artificial Sequence
  Marburg virus siRNA sense strand
gaauauaccuacccugauuua

SEQ ID NO: 31079 - RNA, 21 nt, Artificial Sequence
  Marburg virus siRNA sense strand
aauauaccuacccugauuuau

SEQ ID NO: 31080 - RNA, 21 nt, Artificial Sequence
  Marburg virus siRNA sense strand
auauaccuacccugauuuaua

SEQ ID NO: 31081 - RNA, 21 nt, Artificial Sequence
  Marburg virus siRNA sense strand
uauaccuacccugauuuauau

SEQ ID NO: 31082 - RNA, 21 nt, Artificial Sequence
  Marburg virus siRNA sense strand
auaccuacccugauuuauauu

SEQ ID NO: 31083 - RNA, 21 nt, Artificial Sequence
  Marburg virus siRNA sense strand
uaccuacccugauuuauauuu

SEQ ID NO: 31084 - RNA, 21 nt, Artificial Sequence
  Marburg virus siRNA sense strand
accuacccugauuuauauuua

SEQ ID NO: 31085 - RNA, 21 nt, Artificial Sequence
  Marburg virus siRNA sense strand
ccuacccugauuuauauuuac

SEQ ID NO: 31086 - RNA, 21 nt, Artificial Sequence
  Marburg virus siRNA sense strand
cuacccugauuuauauuuacu

SEQ ID NO: 31087 - RNA, 21 nt, Artificial Sequence
  Marburg virus siRNA sense strand
uacccugauuuauauuuacug

SEQ ID NO: 31088 - RNA, 21 nt, Artificial Sequence
  Marburg virus siRNA sense strand
acccugauuuauauuuacugg

SEQ ID NO: 31089 - RNA, 21 nt, Artificial Sequence
  Marburg virus siRNA sense strand
cccugauuuauauuuacuggu

SEQ ID NO: 31090 - RNA, 21 nt, Artificial Sequence
  Marburg virus siRNA sense strand
ccugauuuauauuuacuggua

SEQ ID NO: 31091 - RNA, 21 nt, Artificial Sequence
  Marburg virus siRNA sense strand
cugauuuauauuuacugguau

SEQ ID NO: 31092 - RNA, 21 nt, Artificial Sequence
  Marburg virus siRNA sense strand
ugauuuauauuuacugguaua

SEQ ID NO: 31093 - RNA, 21 nt, Artificial Sequence
  Marburg virus siRNA sense strand
gauuuauauuuacugguauaa

SEQ ID NO: 31094 - RNA, 21 nt, Artificial Sequence
  Marburg virus siRNA sense strand
auuuauauuuacugguauaaa

SEQ ID NO: 31095 - RNA, 21 nt, Artificial Sequence
  Marburg virus siRNA sense strand
uuuauauuuacugguauaaaa

SEQ ID NO: 31096 - RNA, 21 nt, Artificial Sequence
  Marburg virus siRNA sense strand
uuauauuuacugguauaaaau

SEQ ID NO: 31097 - RNA, 21 nt, Artificial Sequence
  Marburg virus siRNA sense strand
uauauuuacugguauaaaaua

SEQ ID NO: 31098 - RNA, 21 nt, Artificial Sequence
  Marburg virus siRNA sense strand
auauuuacugguauaaaauag

SEQ ID NO: 31099 - RNA, 21 nt, Artificial Sequence
  Marburg virus siRNA sense strand
uauuuacugguauaaaauagu

SEQ ID NO: 31100 - RNA, 21 nt, Artificial Sequence
  Marburg virus siRNA sense strand
auuuacugguauaaaauagug

SEQ ID NO: 31101 - RNA, 21 nt, Artificial Sequence
  Marburg virus siRNA sense strand
uuuacugguauaaaauagugg

SEQ ID NO: 31102 - RNA, 21 nt, Artificial Sequence
  Marburg virus siRNA sense strand
uuacugguauaaaauaguggu

SEQ ID NO: 31103 - RNA, 21 nt, Artificial Sequence
  Marburg virus siRNA sense strand
uacugguauaaaauaguggua

SEQ ID NO: 31104 - RNA, 21 nt, Artificial Sequence
  Marburg virus siRNA sense strand
acugguauaaaauagugguau

SEQ ID NO: 31105 - RNA, 21 nt, Artificial Sequence
  Marburg virus siRNA sense strand
cugguauaaaauagugguauc

SEQ ID NO: 31106 - RNA, 21 nt, Artificial Sequence
  Marburg virus siRNA sense strand
ugguauaaaauagugguauca

SEQ ID NO: 31107 - RNA, 21 nt, Artificial Sequence
  Marburg virus siRNA sense strand
gguauaaaauagugguaucau

SEQ ID NO: 31108 - RNA, 21 nt, Artificial Sequence
  Marburg virus siRNA sense strand
guauaaaauagugguaucauc

SEQ ID NO: 31109 - RNA, 21 nt, Artificial Sequence
  Marburg virus siRNA sense strand
uauaaaauagugguaucaucu

SEQ ID NO: 31110 - RNA, 21 nt, Artificial Sequence
  Marburg virus siRNA sense strand
auaaaauagugguaucaucuu

SEQ ID NO: 31111 - RNA, 21 nt, Artificial Sequence
  Marburg virus siRNA sense strand
uaaaauagugguaucaucuua

SEQ ID NO: 31112 - RNA, 21 nt, Artificial Sequence
  Marburg virus siRNA sense strand
aaaauagugguaucaucuuau

SEQ ID NO: 31113 - RNA, 21 nt, Artificial Sequence
  Marburg virus siRNA sense strand
aaauagugguaucaucuuauu

SEQ ID NO: 31114 - RNA, 21 nt, Artificial Sequence
  Marburg virus siRNA sense strand
aauagugguaucaucuuauua

SEQ ID NO: 31115 - RNA, 21 nt, Artificial Sequence
  Marburg virus siRNA sense strand
auagugguaucaucuuauuaa

SEQ ID NO: 31116 - RNA, 21 nt, Artificial Sequence
  Marburg virus siRNA sense strand
uagugguaucaucuuauuaaa

SEQ ID NO: 31117 - RNA, 21 nt, Artificial Sequence
  Marburg virus siRNA sense strand
agugguaucaucuuauuaaau

SEQ ID NO: 31118 - RNA, 21 nt, Artificial Sequence
  Marburg virus siRNA sense strand
gugguaucaucuuauuaaaua

SEQ ID NO: 31119 - RNA, 21 nt, Artificial Sequence
  Marburg virus siRNA sense strand
ugguaucaucuuauuaaauag

SEQ ID NO: 31120 - RNA, 21 nt, Artificial Sequence
  Marburg virus siRNA sense strand
gguaucaucuuauuaaauagu

SEQ ID NO: 31121 - RNA, 21 nt, Artificial Sequence
  Marburg virus siRNA sense strand
guaucaucuuauuaaauaguu

SEQ ID NO: 31122 - RNA, 21 nt, Artificial Sequence
  Marburg virus siRNA sense strand
uaucaucuuauuaaauaguug

SEQ ID NO: 31123 - RNA, 21 nt, Artificial Sequence
  Marburg virus siRNA sense strand
aucaucuuauuaaauaguugu

SEQ ID NO: 31124 - RNA, 21 nt, Artificial Sequence
  Marburg virus siRNA sense strand
ucaucuuauuaaauaguuguc

SEQ ID NO: 31125 - RNA, 21 nt, Artificial Sequence
  Marburg virus siRNA sense strand
caucuuauuaaauaguuguca

SEQ ID NO: 31126 - RNA, 21 nt, Artificial Sequence
  Marburg virus siRNA sense strand
aucuuauuaaauaguugucau

SEQ ID NO: 31127 - RNA, 21 nt, Artificial Sequence
  Marburg virus siRNA sense strand
ucuuauuaaauaguugucaua

SEQ ID NO: 31128 - RNA, 21 nt, Artificial Sequence
  Marburg virus siRNA sense strand
cuuauuaaauaguugucauau

SEQ ID NO: 31129 - RNA, 21 nt, Artificial Sequence
  Marburg virus siRNA sense strand
uuauuaaauaguugucauaua

SEQ ID NO: 31130 - RNA, 21 nt, Artificial Sequence
  Marburg virus siRNA sense strand
uauuaaauaguugucauauaa

SEQ ID NO: 31131 - RNA, 21 nt, Artificial Sequence
  Marburg virus siRNA sense strand
auuaaauaguugucauauaac

SEQ ID NO: 31132 - RNA, 21 nt, Artificial Sequence
  Marburg virus siRNA sense strand
uuaaauaguugucauauaaca

SEQ ID NO: 31133 - RNA, 21 nt, Artificial Sequence
  Marburg virus siRNA sense strand
uaaauaguugucauauaacag

SEQ ID NO: 31134 - RNA, 21 nt, Artificial Sequence
  Marburg virus siRNA sense strand
aaauaguugucauauaacagg

SEQ ID NO: 31135 - RNA, 21 nt, Artificial Sequence
  Marburg virus siRNA sense strand
aauaguugucauauaacaggc

SEQ ID NO: 31136 - RNA, 21 nt, Artificial Sequence
  Marburg virus siRNA sense strand
auaguugucauauaacaggcu

SEQ ID NO: 31137 - RNA, 21 nt, Artificial Sequence
  Marburg virus siRNA sense strand
uaguugucauauaacaggcug

SEQ ID NO: 31138 - RNA, 21 nt, Artificial Sequence
  Marburg virus siRNA sense strand
aguugucauauaacaggcugu

SEQ ID NO: 31139 - RNA, 21 nt, Artificial Sequence
  Marburg virus siRNA sense strand
guugucauauaacaggcuguu

SEQ ID NO: 31140 - RNA, 21 nt, Artificial Sequence
  Marburg virus siRNA sense strand
uugucauauaacaggcuguuc

SEQ ID NO: 31141 - RNA, 21 nt, Artificial Sequence
  Marburg virus siRNA sense strand
ugucauauaacaggcuguucc

SEQ ID NO: 31142 - RNA, 21 nt, Artificial Sequence
  Marburg virus siRNA sense strand
gucauauaacaggcuguuccu

SEQ ID NO: 31143 - RNA, 21 nt, Artificial Sequence
  Marburg virus siRNA sense strand
ucauauaacaggcuguuccua

SEQ ID NO: 31144 - RNA, 21 nt, Artificial Sequence
  Marburg virus siRNA sense strand
cauauaacaggcuguuccuau

SEQ ID NO: 31145 - RNA, 21 nt, Artificial Sequence
  Marburg virus siRNA sense strand
auauaacaggcuguuccuaua

SEQ ID NO: 31146 - RNA, 21 nt, Artificial Sequence
  Marburg virus siRNA sense strand
uauaacaggcuguuccuauaa

SEQ ID NO: 31147 - RNA, 21 nt, Artificial Sequence
  Marburg virus siRNA sense strand
auaacaggcuguuccuauaau

SEQ ID NO: 31148 - RNA, 21 nt, Artificial Sequence
  Marburg virus siRNA sense strand
uaacaggcuguuccuauaauc

SEQ ID NO: 31149 - RNA, 21 nt, Artificial Sequence
  Marburg virus siRNA sense strand
aacaggcuguuccuauaaucu

SEQ ID NO: 31150 - RNA, 21 nt, Artificial Sequence
  Marburg virus siRNA sense strand
acaggcuguuccuauaaucug

SEQ ID NO: 31151 - RNA, 21 nt, Artificial Sequence
  Marburg virus siRNA sense strand
caggcuguuccuauaaucuga

SEQ ID NO: 31152 - RNA, 21 nt, Artificial Sequence
  Marburg virus siRNA sense strand
aggcuguuccuauaaucugau

SEQ ID NO: 31153 - RNA, 21 nt, Artificial Sequence
  Marburg virus siRNA sense strand
ggcuguuccuauaaucugauu

SEQ ID NO: 31154 - RNA, 21 nt, Artificial Sequence
  Marburg virus siRNA sense strand
gcuguuccuauaaucugauug

SEQ ID NO: 31155 - RNA, 21 nt, Artificial Sequence
  Marburg virus siRNA sense strand
cuguuccuauaaucugauugu

SEQ ID NO: 31156 - RNA, 21 nt, Artificial Sequence
  Marburg virus siRNA sense strand
uguuccuauaaucugauugug

SEQ ID NO: 31157 - RNA, 21 nt, Artificial Sequence
  Marburg virus siRNA sense strand
guuccuauaaucugauuguga

SEQ ID NO: 31158 - RNA, 21 nt, Artificial Sequence
  Marburg virus siRNA sense strand
uuccuauaaucugauugugag

SEQ ID NO: 31159 - RNA, 21 nt, Artificial Sequence
  Marburg virus siRNA sense strand
uccuauaaucugauugugaga

SEQ ID NO: 31160 - RNA, 21 nt, Artificial Sequence
  Marburg virus siRNA sense strand
ccuauaaucugauugugagau

SEQ ID NO: 31161 - RNA, 21 nt, Artificial Sequence
  Marburg virus siRNA sense strand
cuauaaucugauugugagauu

SEQ ID NO: 31162 - RNA, 21 nt, Artificial Sequence
  Marburg virus siRNA sense strand
uauaaucugauugugagauua

SEQ ID NO: 31163 - RNA, 21 nt, Artificial Sequence
  Marburg virus siRNA sense strand
auaaucugauugugagauuau

SEQ ID NO: 31164 - RNA, 21 nt, Artificial Sequence
  Marburg virus siRNA sense strand
uaaucugauugugagauuaua

SEQ ID NO: 31165 - RNA, 21 nt, Artificial Sequence
  Marburg virus siRNA sense strand
aaucugauugugagauuauaa

SEQ ID NO: 31166 - RNA, 21 nt, Artificial Sequence
  Marburg virus siRNA sense strand
aucugauugugagauuauaaa

SEQ ID NO: 31167 - RNA, 21 nt, Artificial Sequence
  Marburg virus siRNA sense strand
ucugauugugagauuauaaac

SEQ ID NO: 31168 - RNA, 21 nt, Artificial Sequence
  Marburg virus siRNA sense strand
cugauugugagauuauaaacu

SEQ ID NO: 31169 - RNA, 21 nt, Artificial Sequence
  Marburg virus siRNA sense strand
ugauugugagauuauaaacuu

SEQ ID NO: 31170 - RNA, 21 nt, Artificial Sequence
  Marburg virus siRNA sense strand
gauugugagauuauaaacuug

SEQ ID NO: 31171 - RNA, 21 nt, Artificial Sequence
  Marburg virus siRNA sense strand
auugugagauuauaaacuugu

SEQ ID NO: 31172 - RNA, 21 nt, Artificial Sequence
  Marburg virus siRNA sense strand
uugugagauuauaaacuugua

SEQ ID NO: 31173 - RNA, 21 nt, Artificial Sequence
  Marburg virus siRNA sense strand
ugugagauuauaaacuuguag

SEQ ID NO: 31174 - RNA, 21 nt, Artificial Sequence
  Marburg virus siRNA sense strand
gugagauuauaaacuuguaga

SEQ ID NO: 31175 - RNA, 21 nt, Artificial Sequence
  Marburg virus siRNA sense strand
ugagauuauaaacuuguagaa

SEQ ID NO: 31176 - RNA, 21 nt, Artificial Sequence
  Marburg virus siRNA sense strand
gagauuauaaacuuguagaau

SEQ ID NO: 31177 - RNA, 21 nt, Artificial Sequence
  Marburg virus siRNA sense strand
agauuauaaacuuguagaauu

SEQ ID NO: 31178 - RNA, 21 nt, Artificial Sequence
  Marburg virus siRNA sense strand
gauuauaaacuuguagaauua

SEQ ID NO: 31179 - RNA, 21 nt, Artificial Sequence
  Marburg virus siRNA sense strand
auuauaaacuuguagaauuac

SEQ ID NO: 31180 - RNA, 21 nt, Artificial Sequence
  Marburg virus siRNA sense strand
uuauaaacuuguagaauuacc

SEQ ID NO: 31181 - RNA, 21 nt, Artificial Sequence
  Marburg virus siRNA sense strand
uauaaacuuguagaauuaccg

SEQ ID NO: 31182 - RNA, 21 nt, Artificial Sequence
  Marburg virus siRNA sense strand
auaaacuuguagaauuaccgu

SEQ ID NO: 31183 - RNA, 21 nt, Artificial Sequence
  Marburg virus siRNA sense strand
uaaacuuguagaauuaccgug

SEQ ID NO: 31184 - RNA, 21 nt, Artificial Sequence
  Marburg virus siRNA sense strand
aaacuuguagaauuaccgugg

SEQ ID NO: 31185 - RNA, 21 nt, Artificial Sequence
  Marburg virus siRNA sense strand
aacuuguagaauuaccgugga

SEQ ID NO: 31186 - RNA, 21 nt, Artificial Sequence
  Marburg virus siRNA sense strand
acuuguagaauuaccguggau

SEQ ID NO: 31187 - RNA, 21 nt, Artificial Sequence
  Marburg virus siRNA sense strand
cuuguagaauuaccguggauc

SEQ ID NO: 31188 - RNA, 21 nt, Artificial Sequence
  Marburg virus siRNA sense strand
uuguagaauuaccguggauca

SEQ ID NO: 31189 - RNA, 21 nt, Artificial Sequence
  Marburg virus siRNA sense strand
uguagaauuaccguggaucac

SEQ ID NO: 31190 - RNA, 21 nt, Artificial Sequence
  Marburg virus siRNA sense strand
guagaauuaccguggaucaca

SEQ ID NO: 31191 - RNA, 21 nt, Artificial Sequence
  Marburg virus siRNA sense strand
uagaauuaccguggaucacaa

SEQ ID NO: 31192 - RNA, 21 nt, Artificial Sequence
  Marburg virus siRNA sense strand
agaauuaccguggaucacaac

SEQ ID NO: 31193 - RNA, 21 nt, Artificial Sequence
  Marburg virus siRNA sense strand
gaauuaccguggaucacaacu

SEQ ID NO: 31194 - RNA, 21 nt, Artificial Sequence
  Marburg virus siRNA sense strand
aauuaccguggaucacaacug

SEQ ID NO: 31195 - RNA, 21 nt, Artificial Sequence
  Marburg virus siRNA sense strand
auuaccguggaucacaacugu

SEQ ID NO: 31196 - RNA, 21 nt, Artificial Sequence
  Marburg virus siRNA sense strand
uuaccguggaucacaacuguu

SEQ ID NO: 31197 - RNA, 21 nt, Artificial Sequence
  Marburg virus siRNA sense strand
uaccguggaucacaacuguug

SEQ ID NO: 31198 - RNA, 21 nt, Artificial Sequence
  Marburg virus siRNA sense strand
accguggaucacaacuguugc

SEQ ID NO: 31199 - RNA, 21 nt, Artificial Sequence
  Marburg virus siRNA sense strand
ccguggaucacaacuguugca

SEQ ID NO: 31200 - RNA, 21 nt, Artificial Sequence
  Marburg virus siRNA sense strand
cguggaucacaacuguugcau

SEQ ID NO: 31201 - RNA, 21 nt, Artificial Sequence
  Marburg virus siRNA sense strand
guggaucacaacuguugcaua

SEQ ID NO: 31202 - RNA, 21 nt, Artificial Sequence
  Marburg virus siRNA sense strand
uggaucacaacuguugcauau

SEQ ID NO: 31203 - RNA, 21 nt, Artificial Sequence
  Marburg virus siRNA sense strand
ggaucacaacuguugcauauc

SEQ ID NO: 31204 - RNA, 21 nt, Artificial Sequence
  Marburg virus siRNA sense strand
gaucacaacuguugcauaucu

SEQ ID NO: 31205 - RNA, 21 nt, Artificial Sequence
  Marburg virus siRNA sense strand
aucacaacuguugcauaucuu

SEQ ID NO: 31206 - RNA, 21 nt, Artificial Sequence
  Marburg virus siRNA sense strand
ucacaacuguugcauaucuuc

SEQ ID NO: 31207 - RNA, 21 nt, Artificial Sequence
  Marburg virus siRNA sense strand
cacaacuguugcauaucuucc

SEQ ID NO: 31208 - RNA, 21 nt, Artificial Sequence
  Marburg virus siRNA sense strand
acaacuguugcauaucuucca

SEQ ID NO: 31209 - RNA, 21 nt, Artificial Sequence
  Marburg virus siRNA sense strand
caacuguugcauaucuuccaa

SEQ ID NO: 31210 - RNA, 21 nt, Artificial Sequence
  Marburg virus siRNA sense strand
aacuguugcauaucuuccaaa

SEQ ID NO: 31211 - RNA, 21 nt, Artificial Sequence
  Marburg virus siRNA sense strand
acuguugcauaucuuccaaaa

SEQ ID NO: 31212 - RNA, 21 nt, Artificial Sequence
  Marburg virus siRNA sense strand
cuguugcauaucuuccaaaau

SEQ ID NO: 31213 - RNA, 21 nt, Artificial Sequence
  Marburg virus siRNA sense strand
uguugcauaucuuccaaaaua

SEQ ID NO: 31214 - RNA, 21 nt, Artificial Sequence
  Marburg virus siRNA sense strand
guugcauaucuuccaaaauau

SEQ ID NO: 31215 - RNA, 21 nt, Artificial Sequence
  Marburg virus siRNA sense strand
uugcauaucuuccaaaauaua

SEQ ID NO: 31216 - RNA, 21 nt, Artificial Sequence
  Marburg virus siRNA sense strand
ugcauaucuuccaaaauauau

SEQ ID NO: 31217 - RNA, 21 nt, Artificial Sequence
  Marburg virus siRNA sense strand
gcauaucuuccaaaauauauc

SEQ ID NO: 31218 - RNA, 21 nt, Artificial Sequence
  Marburg virus siRNA sense strand
cauaucuuccaaaauauaucu

SEQ ID NO: 31219 - RNA, 21 nt, Artificial Sequence
  Marburg virus siRNA sense strand
auaucuuccaaaauauaucuu

SEQ ID NO: 31220 - RNA, 21 nt, Artificial Sequence
  Marburg virus siRNA sense strand
uaucuuccaaaauauaucuuu

SEQ ID NO: 31221 - RNA, 21 nt, Artificial Sequence
  Marburg virus siRNA sense strand
aucuuccaaaauauaucuuuu

SEQ ID NO: 31222 - RNA, 21 nt, Artificial Sequence
  Marburg virus siRNA sense strand
ucuuccaaaauauaucuuuug

SEQ ID NO: 31223 - RNA, 21 nt, Artificial Sequence
  Marburg virus siRNA sense strand
cuuccaaaauauaucuuuugc

SEQ ID NO: 31224 - RNA, 21 nt, Artificial Sequence
  Marburg virus siRNA sense strand
uuccaaaauauaucuuuugca

SEQ ID NO: 31225 - RNA, 21 nt, Artificial Sequence
  Marburg virus siRNA sense strand
uccaaaauauaucuuuugcaa

SEQ ID NO: 31226 - RNA, 21 nt, Artificial Sequence
  Marburg virus siRNA sense strand
ccaaaauauaucuuuugcaag

SEQ ID NO: 31227 - RNA, 21 nt, Artificial Sequence
  Marburg virus siRNA sense strand
caaaauauaucuuuugcaagc

SEQ ID NO: 31228 - RNA, 21 nt, Artificial Sequence
  Marburg virus siRNA sense strand
aaaauauaucuuuugcaagcg

SEQ ID NO: 31229 - RNA, 21 nt, Artificial Sequence
  Marburg virus siRNA sense strand
aaauauaucuuuugcaagcga

SEQ ID NO: 31230 - RNA, 21 nt, Artificial Sequence
  Marburg virus siRNA sense strand
aauauaucuuuugcaagcgau

SEQ ID NO: 31231 - RNA, 21 nt, Artificial Sequence
  Marburg virus siRNA sense strand
auauaucuuuugcaagcgaug

SEQ ID NO: 31232 - RNA, 21 nt, Artificial Sequence
  Marburg virus siRNA sense strand
uauaucuuuugcaagcgaugu

SEQ ID NO: 31233 - RNA, 21 nt, Artificial Sequence
  Marburg virus siRNA sense strand
auaucuuuugcaagcgaugug

SEQ ID NO: 31234 - RNA, 21 nt, Artificial Sequence
  Marburg virus siRNA sense strand
uaucuuuugcaagcgaugugu

SEQ ID NO: 31235 - RNA, 21 nt, Artificial Sequence
  Marburg virus siRNA sense strand
aucuuuugcaagcgaugugug

SEQ ID NO: 31236 - RNA, 21 nt, Artificial Sequence
  Marburg virus siRNA sense strand
ucuuuugcaagcgaugugugc

SEQ ID NO: 31237 - RNA, 21 nt, Artificial Sequence
  Marburg virus siRNA sense strand
cuuuugcaagcgaugugugcu

SEQ ID NO: 31238 - RNA, 21 nt, Artificial Sequence
  Marburg virus siRNA sense strand
uuuugcaagcgaugugugcuu

SEQ ID NO: 31239 - RNA, 21 nt, Artificial Sequence
  Marburg virus siRNA sense strand
uuugcaagcgaugugugcuug

SEQ ID NO: 31240 - RNA, 21 nt, Artificial Sequence
  Marburg virus siRNA sense strand
uugcaagcgaugugugcuuga

SEQ ID NO: 31241 - RNA, 21 nt, Artificial Sequence
  Marburg virus siRNA sense strand
ugcaagcgaugugugcuugaa

SEQ ID NO: 31242 - RNA, 21 nt, Artificial Sequence
  Marburg virus siRNA sense strand
gcaagcgaugugugcuugaau

SEQ ID NO: 31243 - RNA, 21 nt, Artificial Sequence
  Marburg virus siRNA sense strand
caagcgaugugugcuugaaua

SEQ ID NO: 31244 - RNA, 21 nt, Artificial Sequence
  Marburg virus siRNA sense strand
aagcgaugugugcuugaauac

SEQ ID NO: 31245 - RNA, 21 nt, Artificial Sequence
  Marburg virus siRNA sense strand
agcgaugugugcuugaauacg

SEQ ID NO: 31246 - RNA, 21 nt, Artificial Sequence
  Marburg virus siRNA sense strand
gcgaugugugcuugaauacgu

SEQ ID NO: 31247 - RNA, 21 nt, Artificial Sequence
  Marburg virus siRNA sense strand
cgaugugugcuugaauacguc

SEQ ID NO: 31248 - RNA, 21 nt, Artificial Sequence
  Marburg virus siRNA sense strand
gaugugugcuugaauacgucg

SEQ ID NO: 31249 - RNA, 21 nt, Artificial Sequence
  Marburg virus siRNA sense strand
augugugcuugaauacgucga

SEQ ID NO: 31250 - RNA, 21 nt, Artificial Sequence
  Marburg virus siRNA sense strand
ugugugcuugaauacgucgau

SEQ ID NO: 31251 - RNA, 21 nt, Artificial Sequence
  Marburg virus siRNA sense strand
gugugcuugaauacgucgaua

SEQ ID NO: 31252 - RNA, 21 nt, Artificial Sequence
  Marburg virus siRNA sense strand
ugugcuugaauacgucgauau

SEQ ID NO: 31253 - RNA, 21 nt, Artificial Sequence
  Marburg virus siRNA sense strand
gugcuugaauacgucgauaua

SEQ ID NO: 31254 - RNA, 21 nt, Artificial Sequence
  Marburg virus siRNA sense strand
ugcuugaauacgucgauauaa

SEQ ID NO: 31255 - RNA, 21 nt, Artificial Sequence
  Marburg virus siRNA sense strand
gcuugaauacgucgauauaau

SEQ ID NO: 31256 - RNA, 21 nt, Artificial Sequence
  Marburg virus siRNA sense strand
cuugaauacgucgauauaaua

SEQ ID NO: 31257 - RNA, 21 nt, Artificial Sequence
  Marburg virus siRNA sense strand
uugaauacgucgauauaauac

SEQ ID NO: 31258 - RNA, 21 nt, Artificial Sequence
  Marburg virus siRNA sense strand
ugaauacgucgauauaauaca

SEQ ID NO: 31259 - RNA, 21 nt, Artificial Sequence
  Marburg virus siRNA sense strand
gaauacgucgauauaauacau

SEQ ID NO: 31260 - RNA, 21 nt, Artificial Sequence
  Marburg virus siRNA sense strand
aauacgucgauauaauacaua

SEQ ID NO: 31261 - RNA, 21 nt, Artificial Sequence
  Marburg virus siRNA sense strand
auacgucgauauaauacauac

SEQ ID NO: 31262 - RNA, 21 nt, Artificial Sequence
  Marburg virus siRNA sense strand
uacgucgauauaauacauacu

SEQ ID NO: 31263 - RNA, 21 nt, Artificial Sequence
  Marburg virus siRNA sense strand
acgucgauauaauacauacua

SEQ ID NO: 31264 - RNA, 21 nt, Artificial Sequence
  Marburg virus siRNA sense strand
cgucgauauaauacauacuaa

SEQ ID NO: 31265 - RNA, 21 nt, Artificial Sequence
  Marburg virus siRNA sense strand
gucgauauaauacauacuaau

SEQ ID NO: 31266 - RNA, 21 nt, Artificial Sequence
  Marburg virus siRNA sense strand
ucgauauaauacauacuaaua

SEQ ID NO: 31267 - RNA, 21 nt, Artificial Sequence
  Marburg virus siRNA sense strand
cgauauaauacauacuaauaa

SEQ ID NO: 31268 - RNA, 21 nt, Artificial Sequence
  Marburg virus siRNA sense strand
gauauaauacauacuaauaac

SEQ ID NO: 31269 - RNA, 21 nt, Artificial Sequence
  Marburg virus siRNA sense strand
auauaauacauacuaauaacg

SEQ ID NO: 31270 - RNA, 21 nt, Artificial Sequence
  Marburg virus siRNA sense strand
uauaauacauacuaauaacga

SEQ ID NO: 31271 - RNA, 21 nt, Artificial Sequence
  Marburg virus siRNA sense strand
auaauacauacuaauaacgau

SEQ ID NO: 31272 - RNA, 21 nt, Artificial Sequence
  Marburg virus siRNA sense strand
uaauacauacuaauaacgauu

SEQ ID NO: 31273 - RNA, 21 nt, Artificial Sequence
  Marburg virus siRNA sense strand
aauacauacuaauaacgauug

SEQ ID NO: 31274 - RNA, 21 nt, Artificial Sequence
  Marburg virus siRNA sense strand
auacauacuaauaacgauuga

SEQ ID NO: 31275 - RNA, 21 nt, Artificial Sequence
  Marburg virus siRNA sense strand
uacauacuaauaacgauugau

SEQ ID NO: 31276 - RNA, 21 nt, Artificial Sequence
  Marburg virus siRNA sense strand
acauacuaauaacgauugauu

SEQ ID NO: 31277 - RNA, 21 nt, Artificial Sequence
  Marburg virus siRNA sense strand
cauacuaauaacgauugauua

SEQ ID NO: 31278 - RNA, 21 nt, Artificial Sequence
  Marburg virus siRNA sense strand
auacuaauaacgauugauuaa

SEQ ID NO: 31279 - RNA, 21 nt, Artificial Sequence
  Marburg virus siRNA sense strand
uacuaauaacgauugauuaag

SEQ ID NO: 31280 - RNA, 21 nt, Artificial Sequence
  Marburg virus siRNA sense strand
acuaauaacgauugauuaaga

SEQ ID NO: 31281 - RNA, 21 nt, Artificial Sequence
  Marburg virus siRNA sense strand
cuaauaacgauugauuaagaa

SEQ ID NO: 31282 - RNA, 21 nt, Artificial Sequence
  Marburg virus siRNA sense strand
uaauaacgauugauuaagaaa

SEQ ID NO: 31283 - RNA, 21 nt, Artificial Sequence
  Marburg virus siRNA sense strand
aauaacgauugauuaagaaaa

SEQ ID NO: 31284 - RNA, 21 nt, Artificial Sequence
  Marburg virus siRNA sense strand
auaacgauugauuaagaaaaa

SEQ ID NO: 31285 - RNA, 21 nt, Artificial Sequence
  Marburg virus siRNA sense strand
uaacgauugauuaagaaaaac

SEQ ID NO: 31286 - RNA, 21 nt, Artificial Sequence
  Marburg virus siRNA sense strand
aacgauugauuaagaaaaacc

SEQ ID NO: 31287 - RNA, 21 nt, Artificial Sequence
  Marburg virus siRNA sense strand
acgauugauuaagaaaaacca

SEQ ID NO: 31288 - RNA, 21 nt, Artificial Sequence
  Marburg virus siRNA sense strand
cgauugauuaagaaaaaccaa

SEQ ID NO: 31289 - RNA, 21 nt, Artificial Sequence
  Marburg virus siRNA sense strand
gauugauuaagaaaaaccaau

SEQ ID NO: 31290 - RNA, 21 nt, Artificial Sequence
  Marburg virus siRNA sense strand
auugauuaagaaaaaccaaug

SEQ ID NO: 31291 - RNA, 21 nt, Artificial Sequence
  Marburg virus siRNA sense strand
uugauuaagaaaaaccaauga

SEQ ID NO: 31292 - RNA, 21 nt, Artificial Sequence
  Marburg virus siRNA sense strand
ugauuaagaaaaaccaaugau

SEQ ID NO: 31293 - RNA, 21 nt, Artificial Sequence
  Marburg virus siRNA sense strand
gauuaagaaaaaccaaugaug

SEQ ID NO: 31294 - RNA, 21 nt, Artificial Sequence
  Marburg virus siRNA sense strand
auuaagaaaaaccaaugaugg

SEQ ID NO: 31295 - RNA, 21 nt, Artificial Sequence
  Marburg virus siRNA sense strand
uuaagaaaaaccaaugaugga

SEQ ID NO: 31296 - RNA, 21 nt, Artificial Sequence
  Marburg virus siRNA sense strand
uaagaaaaaccaaugauggau

SEQ ID NO: 31297 - RNA, 21 nt, Artificial Sequence
  Marburg virus siRNA sense strand
aagaaaaaccaaugauggaua

SEQ ID NO: 31298 - RNA, 21 nt, Artificial Sequence
  Marburg virus siRNA sense strand
agaaaaaccaaugauggauau

SEQ ID NO: 31299 - RNA, 21 nt, Artificial Sequence
  Marburg virus siRNA sense strand
gaaaaaccaaugauggauauu

SEQ ID NO: 31300 - RNA, 21 nt, Artificial Sequence
  Marburg virus siRNA sense strand
aaaaaccaaugauggauauua

SEQ ID NO: 31301 - RNA, 21 nt, Artificial Sequence
  Marburg virus siRNA sense strand
aaaaccaaugauggauauuaa

SEQ ID NO: 31302 - RNA, 21 nt, Artificial Sequence
  Marburg virus siRNA sense strand
aaaccaaugauggauauuaaa

SEQ ID NO: 31303 - RNA, 21 nt, Artificial Sequence
  Marburg virus siRNA sense strand
aaccaaugauggauauuaaau

SEQ ID NO: 31304 - RNA, 21 nt, Artificial Sequence
  Marburg virus siRNA sense strand
accaaugauggauauuaaaua

SEQ ID NO: 31305 - RNA, 21 nt, Artificial Sequence
  Marburg virus siRNA sense strand
ccaaugauggauauuaaauau

SEQ ID NO: 31306 - RNA, 21 nt, Artificial Sequence
  Marburg virus siRNA sense strand
caaugauggauauuaaauauc

SEQ ID NO: 31307 - RNA, 21 nt, Artificial Sequence
  Marburg virus siRNA sense strand
aaugauggauauuaaauaucc

SEQ ID NO: 31308 - RNA, 21 nt, Artificial Sequence
  Marburg virus siRNA sense strand
augauggauauuaaauaucca

SEQ ID NO: 31309 - RNA, 21 nt, Artificial Sequence
  Marburg virus siRNA sense strand
ugauggauauuaaauauccau

SEQ ID NO: 31310 - RNA, 21 nt, Artificial Sequence
  Marburg virus siRNA sense strand
gauggauauuaaauauccauc

SEQ ID NO: 31311 - RNA, 21 nt, Artificial Sequence
  Marburg virus siRNA sense strand
auggauauuaaauauccauca

SEQ ID NO: 31312 - RNA, 21 nt, Artificial Sequence
  Marburg virus siRNA sense strand
uggauauuaaauauccaucaa

SEQ ID NO: 31313 - RNA, 21 nt, Artificial Sequence
  Marburg virus siRNA sense strand
ggauauuaaauauccaucaag

SEQ ID NO: 31314 - RNA, 21 nt, Artificial Sequence
  Marburg virus siRNA sense strand
gauauuaaauauccaucaagc

SEQ ID NO: 31315 - RNA, 21 nt, Artificial Sequence
  Marburg virus siRNA sense strand
auauuaaauauccaucaagca

SEQ ID NO: 31316 - RNA, 21 nt, Artificial Sequence
  Marburg virus siRNA sense strand
uauuaaauauccaucaagcag

SEQ ID NO: 31317 - RNA, 21 nt, Artificial Sequence
  Marburg virus siRNA sense strand
auuaaauauccaucaagcagg

SEQ ID NO: 31318 - RNA, 21 nt, Artificial Sequence
  Marburg virus siRNA sense strand
uuaaauauccaucaagcaggu

SEQ ID NO: 31319 - RNA, 21 nt, Artificial Sequence
  Marburg virus siRNA sense strand
uaaauauccaucaagcaggug

SEQ ID NO: 31320 - RNA, 21 nt, Artificial Sequence
  Marburg virus siRNA sense strand
aaauauccaucaagcaggugu

SEQ ID NO: 31321 - RNA, 21 nt, Artificial Sequence
  Marburg virus siRNA sense strand
aauauccaucaagcagguguc

SEQ ID NO: 31322 - RNA, 21 nt, Artificial Sequence
  Marburg virus siRNA sense strand
auauccaucaagcaggugucg

SEQ ID NO: 31323 - RNA, 21 nt, Artificial Sequence
  Marburg virus siRNA sense strand
uauccaucaagcaggugucgc

SEQ ID NO: 31324 - RNA, 21 nt, Artificial Sequence
  Marburg virus siRNA sense strand
auccaucaagcaggugucgca

SEQ ID NO: 31325 - RNA, 21 nt, Artificial Sequence
  Marburg virus siRNA sense strand
uccaucaagcaggugucgcag

SEQ ID NO: 31326 - RNA, 21 nt, Artificial Sequence
  Marburg virus siRNA sense strand
ccaucaagcaggugucgcaga

SEQ ID NO: 31327 - RNA, 21 nt, Artificial Sequence
  Marburg virus siRNA sense strand
caucaagcaggugucgcagaa

SEQ ID NO: 31328 - RNA, 21 nt, Artificial Sequence
  Marburg virus siRNA sense strand
aucaagcaggugucgcagaau

SEQ ID NO: 31329 - RNA, 21 nt, Artificial Sequence
  Marburg virus siRNA sense strand
ucaagcaggugucgcagaaua

SEQ ID NO: 31330 - RNA, 21 nt, Artificial Sequence
  Marburg virus siRNA sense strand
caagcaggugucgcagaauac

SEQ ID NO: 31331 - RNA, 21 nt, Artificial Sequence
  Marburg virus siRNA sense strand
aagcaggugucgcagaauacc

SEQ ID NO: 31332 - RNA, 21 nt, Artificial Sequence
  Marburg virus siRNA sense strand
agcaggugucgcagaauacca

SEQ ID NO: 31333 - RNA, 21 nt, Artificial Sequence
  Marburg virus siRNA sense strand
gcaggugucgcagaauaccag

SEQ ID NO: 31334 - RNA, 21 nt, Artificial Sequence
  Marburg virus siRNA sense strand
caggugucgcagaauaccagg

SEQ ID NO: 31335 - RNA, 21 nt, Artificial Sequence
  Marburg virus siRNA sense strand
aggugucgcagaauaccaggg

SEQ ID NO: 31336 - RNA, 21 nt, Artificial Sequence
  Marburg virus siRNA sense strand
ggugucgcagaauaccagggg

SEQ ID NO: 31337 - RNA, 21 nt, Artificial Sequence
  Marburg virus siRNA sense strand
gugucgcagaauaccaggggu

SEQ ID NO: 31338 - RNA, 21 nt, Artificial Sequence
  Marburg virus siRNA sense strand
ugucgcagaauaccagggguu

SEQ ID NO: 31339 - RNA, 21 nt, Artificial Sequence
  Marburg virus siRNA sense strand
gucgcagaauaccagggguuu

SEQ ID NO: 31340 - RNA, 21 nt, Artificial Sequence
  Marburg virus siRNA sense strand
ucgcagaauaccagggguuuc

SEQ ID NO: 31341 - RNA, 21 nt, Artificial Sequence
  Marburg virus siRNA sense strand
cgcagaauaccagggguuuca

SEQ ID NO: 31342 - RNA, 21 nt, Artificial Sequence
  Marburg virus siRNA sense strand
gcagaauaccagggguuucau

SEQ ID NO: 31343 - RNA, 21 nt, Artificial Sequence
  Marburg virus siRNA sense strand
cagaauaccagggguuucaua

SEQ ID NO: 31344 - RNA, 21 nt, Artificial Sequence
  Marburg virus siRNA sense strand
agaauaccagggguuucauau

SEQ ID NO: 31345 - RNA, 21 nt, Artificial Sequence
  Marburg virus siRNA sense strand
gaauaccagggguuucauaug

SEQ ID NO: 31346 - RNA, 21 nt, Artificial Sequence
  Marburg virus siRNA sense strand
aauaccagggguuucauaugc

SEQ ID NO: 31347 - RNA, 21 nt, Artificial Sequence
  Marburg virus siRNA sense strand
auaccagggguuucauaugcu

SEQ ID NO: 31348 - RNA, 21 nt, Artificial Sequence
  Marburg virus siRNA sense strand
uaccagggguuucauaugcug

SEQ ID NO: 31349 - RNA, 21 nt, Artificial Sequence
  Marburg virus siRNA sense strand
accagggguuucauaugcugc

SEQ ID NO: 31350 - RNA, 21 nt, Artificial Sequence
  Marburg virus siRNA sense strand
ccagggguuucauaugcugcc

SEQ ID NO: 31351 - RNA, 21 nt, Artificial Sequence
  Marburg virus siRNA sense strand
cagggguuucauaugcugcca

SEQ ID NO: 31352 - RNA, 21 nt, Artificial Sequence
  Marburg virus siRNA sense strand
agggguuucauaugcugccau

SEQ ID NO: 31353 - RNA, 21 nt, Artificial Sequence
  Marburg virus siRNA sense strand
gggguuucauaugcugccaua

SEQ ID NO: 31354 - RNA, 21 nt, Artificial Sequence
  Marburg virus siRNA sense strand
ggguuucauaugcugccauau

SEQ ID NO: 31355 - RNA, 21 nt, Artificial Sequence
  Marburg virus siRNA sense strand
gguuucauaugcugccauauu

SEQ ID NO: 31356 - RNA, 21 nt, Artificial Sequence
  Marburg virus siRNA sense strand
guuucauaugcugccauauuu

SEQ ID NO: 31357 - RNA, 21 nt, Artificial Sequence
  Marburg virus siRNA sense strand
uuucauaugcugccauauuua

SEQ ID NO: 31358 - RNA, 21 nt, Artificial Sequence
  Marburg virus siRNA sense strand
uucauaugcugccauauuuac

SEQ ID NO: 31359 - RNA, 21 nt, Artificial Sequence
  Marburg virus siRNA sense strand
ucauaugcugccauauuuacu

SEQ ID NO: 31360 - RNA, 21 nt, Artificial Sequence
  Marburg virus siRNA sense strand
cauaugcugccauauuuacua

SEQ ID NO: 31361 - RNA, 21 nt, Artificial Sequence
  Marburg virus siRNA sense strand
auaugcugccauauuuacuaa

SEQ ID NO: 31362 - RNA, 21 nt, Artificial Sequence
  Marburg virus siRNA sense strand
uaugcugccauauuuacuaaa

SEQ ID NO: 31363 - RNA, 21 nt, Artificial Sequence
  Marburg virus siRNA sense strand
augcugccauauuuacuaaau

SEQ ID NO: 31364 - RNA, 21 nt, Artificial Sequence
  Marburg virus siRNA sense strand
ugcugccauauuuacuaaauc

SEQ ID NO: 31365 - RNA, 21 nt, Artificial Sequence
  Marburg virus siRNA sense strand
gcugccauauuuacuaaaucu

SEQ ID NO: 31366 - RNA, 21 nt, Artificial Sequence
  Marburg virus siRNA sense strand
cugccauauuuacuaaaucuu

SEQ ID NO: 31367 - RNA, 21 nt, Artificial Sequence
  Marburg virus siRNA sense strand
ugccauauuuacuaaaucuua

SEQ ID NO: 31368 - RNA, 21 nt, Artificial Sequence
  Marburg virus siRNA sense strand
gccauauuuacuaaaucuuac

SEQ ID NO: 31369 - RNA, 21 nt, Artificial Sequence
  Marburg virus siRNA sense strand
ccauauuuacuaaaucuuaca

SEQ ID NO: 31370 - RNA, 21 nt, Artificial Sequence
  Marburg virus siRNA sense strand
cauauuuacuaaaucuuacau

SEQ ID NO: 31371 - RNA, 21 nt, Artificial Sequence
  Marburg virus siRNA sense strand
auauuuacuaaaucuuacaua

SEQ ID NO: 31372 - RNA, 21 nt, Artificial Sequence
  Marburg virus siRNA sense strand
uauuuacuaaaucuuacauag

SEQ ID NO: 31373 - RNA, 21 nt, Artificial Sequence
  Marburg virus siRNA sense strand
auuuacuaaaucuuacauagg

SEQ ID NO: 31374 - RNA, 21 nt, Artificial Sequence
  Marburg virus siRNA sense strand
uuuacuaaaucuuacauagga

SEQ ID NO: 31375 - RNA, 21 nt, Artificial Sequence
  Marburg virus siRNA sense strand
uuacuaaaucuuacauaggau

SEQ ID NO: 31376 - RNA, 21 nt, Artificial Sequence
  Marburg virus siRNA sense strand
uacuaaaucuuacauaggauu

SEQ ID NO: 31377 - RNA, 21 nt, Artificial Sequence
  Marburg virus siRNA sense strand
acuaaaucuuacauaggauua

SEQ ID NO: 31378 - RNA, 21 nt, Artificial Sequence
  Marburg virus siRNA sense strand
cuaaaucuuacauaggauuau

SEQ ID NO: 31379 - RNA, 21 nt, Artificial Sequence
  Marburg virus siRNA sense strand
uaaaucuuacauaggauuaua

SEQ ID NO: 31380 - RNA, 21 nt, Artificial Sequence
  Marburg virus siRNA sense strand
aaaucuuacauaggauuauau

SEQ ID NO: 31381 - RNA, 21 nt, Artificial Sequence
  Marburg virus siRNA sense strand
aaucuuacauaggauuauauc

SEQ ID NO: 31382 - RNA, 21 nt, Artificial Sequence
  Marburg virus siRNA sense strand
aucuuacauaggauuauauca

SEQ ID NO: 31383 - RNA, 21 nt, Artificial Sequence
  Marburg virus siRNA sense strand
ucuuacauaggauuauaucau

SEQ ID NO: 31384 - RNA, 21 nt, Artificial Sequence
  Marburg virus siRNA sense strand
cuuacauaggauuauaucauu

SEQ ID NO: 31385 - RNA, 21 nt, Artificial Sequence
  Marburg virus siRNA sense strand
uuacauaggauuauaucauuc

SEQ ID NO: 31386 - RNA, 21 nt, Artificial Sequence
  Marburg virus siRNA sense strand
uacauaggauuauaucauucu

SEQ ID NO: 31387 - RNA, 21 nt, Artificial Sequence
  Marburg virus siRNA sense strand
acauaggauuauaucauucuc

SEQ ID NO: 31388 - RNA, 21 nt, Artificial Sequence
  Marburg virus siRNA sense strand
cauaggauuauaucauucucu

SEQ ID NO: 31389 - RNA, 21 nt, Artificial Sequence
  Marburg virus siRNA sense strand
auaggauuauaucauucucuu

SEQ ID NO: 31390 - RNA, 21 nt, Artificial Sequence
  Marburg virus siRNA sense strand
uaggauuauaucauucucuuc

SEQ ID NO: 31391 - RNA, 21 nt, Artificial Sequence
  Marburg virus siRNA sense strand
aggauuauaucauucucuucg

SEQ ID NO: 31392 - RNA, 21 nt, Artificial Sequence
  Marburg virus siRNA sense strand
ggauuauaucauucucuucga

SEQ ID NO: 31393 - RNA, 21 nt, Artificial Sequence
  Marburg virus siRNA sense strand
gauuauaucauucucuucgau

SEQ ID NO: 31394 - RNA, 21 nt, Artificial Sequence
  Marburg virus siRNA sense strand
auuauaucauucucuucgaua

SEQ ID NO: 31395 - RNA, 21 nt, Artificial Sequence
  Marburg virus siRNA sense strand
uuauaucauucucuucgauac

SEQ ID NO: 31396 - RNA, 21 nt, Artificial Sequence
  Marburg virus siRNA sense strand
uauaucauucucuucgauaca

SEQ ID NO: 31397 - RNA, 21 nt, Artificial Sequence
  Marburg virus siRNA sense strand
auaucauucucuucgauacac

SEQ ID NO: 31398 - RNA, 21 nt, Artificial Sequence
  Marburg virus siRNA sense strand
uaucauucucuucgauacacg

SEQ ID NO: 31399 - RNA, 21 nt, Artificial Sequence
  Marburg virus siRNA sense strand
aucauucucuucgauacacgu

SEQ ID NO: 31400 - RNA, 21 nt, Artificial Sequence
  Marburg virus siRNA sense strand
ucauucucuucgauacacguu

SEQ ID NO: 31401 - RNA, 21 nt, Artificial Sequence
  Marburg virus siRNA sense strand
cauucucuucgauacacguua

SEQ ID NO: 31402 - RNA, 21 nt, Artificial Sequence
  Marburg virus siRNA sense strand
auucucuucgauacacguuau

SEQ ID NO: 31403 - RNA, 21 nt, Artificial Sequence
  Marburg virus siRNA sense strand
uucucuucgauacacguuaua

SEQ ID NO: 31404 - RNA, 21 nt, Artificial Sequence
  Marburg virus siRNA sense strand
ucucuucgauacacguuauau

SEQ ID NO: 31405 - RNA, 21 nt, Artificial Sequence
  Marburg virus siRNA sense strand
cucuucgauacacguuauauc

SEQ ID NO: 31406 - RNA, 21 nt, Artificial Sequence
  Marburg virus siRNA sense strand
ucuucgauacacguuauaucu

SEQ ID NO: 31407 - RNA, 21 nt, Artificial Sequence
  Marburg virus siRNA sense strand
cuucgauacacguuauaucuu

SEQ ID NO: 31408 - RNA, 21 nt, Artificial Sequence
  Marburg virus siRNA sense strand
uucgauacacguuauaucuuu

SEQ ID NO: 31409 - RNA, 21 nt, Artificial Sequence
  Marburg virus siRNA sense strand
ucgauacacguuauaucuuua

SEQ ID NO: 31410 - RNA, 21 nt, Artificial Sequence
  Marburg virus siRNA sense strand
cgauacacguuauaucuuuag

SEQ ID NO: 31411 - RNA, 21 nt, Artificial Sequence
  Marburg virus siRNA sense strand
gauacacguuauaucuuuagc

SEQ ID NO: 31412 - RNA, 21 nt, Artificial Sequence
  Marburg virus siRNA sense strand
auacacguuauaucuuuagca

SEQ ID NO: 31413 - RNA, 21 nt, Artificial Sequence
  Marburg virus siRNA sense strand
uacacguuauaucuuuagcaa

SEQ ID NO: 31414 - RNA, 21 nt, Artificial Sequence
  Marburg virus siRNA sense strand
acacguuauaucuuuagcaaa

SEQ ID NO: 31415 - RNA, 21 nt, Artificial Sequence
  Marburg virus siRNA sense strand
cacguuauaucuuuagcaaag

SEQ ID NO: 31416 - RNA, 21 nt, Artificial Sequence
  Marburg virus siRNA sense strand
acguuauaucuuuagcaaagu

SEQ ID NO: 31417 - RNA, 21 nt, Artificial Sequence
  Marburg virus siRNA sense strand
cguuauaucuuuagcaaagua

SEQ ID NO: 31418 - RNA, 21 nt, Artificial Sequence
  Marburg virus siRNA sense strand
guuauaucuuuagcaaaguaa

SEQ ID NO: 31419 - RNA, 21 nt, Artificial Sequence
  Marburg virus siRNA sense strand
uuauaucuuuagcaaaguaau

SEQ ID NO: 31420 - RNA, 21 nt, Artificial Sequence
  Marburg virus siRNA sense strand
uauaucuuuagcaaaguaaug

SEQ ID NO: 31421 - RNA, 21 nt, Artificial Sequence
  Marburg virus siRNA sense strand
auaucuuuagcaaaguaauga

SEQ ID NO: 31422 - RNA, 21 nt, Artificial Sequence
  Marburg virus siRNA sense strand
uaucuuuagcaaaguaaugaa

SEQ ID NO: 31423 - RNA, 21 nt, Artificial Sequence
  Marburg virus siRNA sense strand
aucuuuagcaaaguaaugaaa

SEQ ID NO: 31424 - RNA, 21 nt, Artificial Sequence
  Marburg virus siRNA sense strand
ucuuuagcaaaguaaugaaaa

SEQ ID NO: 31425 - RNA, 21 nt, Artificial Sequence
  Marburg virus siRNA sense strand
cuuuagcaaaguaaugaaaau

SEQ ID NO: 31426 - RNA, 21 nt, Artificial Sequence
  Marburg virus siRNA sense strand
uuuagcaaaguaaugaaaaua

SEQ ID NO: 31427 - RNA, 21 nt, Artificial Sequence
  Marburg virus siRNA sense strand
uuagcaaaguaaugaaaauag

SEQ ID NO: 31428 - RNA, 21 nt, Artificial Sequence
  Marburg virus siRNA sense strand
uagcaaaguaaugaaaauagc

SEQ ID NO: 31429 - RNA, 21 nt, Artificial Sequence
  Marburg virus siRNA sense strand
agcaaaguaaugaaaauagcc

SEQ ID NO: 31430 - RNA, 21 nt, Artificial Sequence
  Marburg virus siRNA sense strand
gcaaaguaaugaaaauagccu

SEQ ID NO: 31431 - RNA, 21 nt, Artificial Sequence
  Marburg virus siRNA sense strand
caaaguaaugaaaauagccuu

SEQ ID NO: 31432 - RNA, 21 nt, Artificial Sequence
  Marburg virus siRNA sense strand
aaaguaaugaaaauagccuug

SEQ ID NO: 31433 - RNA, 21 nt, Artificial Sequence
  Marburg virus siRNA sense strand
aaguaaugaaaauagccuugu

SEQ ID NO: 31434 - RNA, 21 nt, Artificial Sequence
  Marburg virus siRNA sense strand
aguaaugaaaauagccuuguc

SEQ ID NO: 31435 - RNA, 21 nt, Artificial Sequence
  Marburg virus siRNA sense strand
guaaugaaaauagccuuguca

SEQ ID NO: 31436 - RNA, 21 nt, Artificial Sequence
  Marburg virus siRNA sense strand
uaaugaaaauagccuugucau

SEQ ID NO: 31437 - RNA, 21 nt, Artificial Sequence
  Marburg virus siRNA sense strand
aaugaaaauagccuugucaug

SEQ ID NO: 31438 - RNA, 21 nt, Artificial Sequence
  Marburg virus siRNA sense strand
augaaaauagccuugucaugu

SEQ ID NO: 31439 - RNA, 21 nt, Artificial Sequence
  Marburg virus siRNA sense strand
ugaaaauagccuugucauguu

SEQ ID NO: 31440 - RNA, 21 nt, Artificial Sequence
  Marburg virus siRNA sense strand
gaaaauagccuugucauguua

SEQ ID NO: 31441 - RNA, 21 nt, Artificial Sequence
  Marburg virus siRNA sense strand
aaaauagccuugucauguuag

SEQ ID NO: 31442 - RNA, 21 nt, Artificial Sequence
  Marburg virus siRNA sense strand
aaauagccuugucauguuaga

SEQ ID NO: 31443 - RNA, 21 nt, Artificial Sequence
  Marburg virus siRNA sense strand
aauagccuugucauguuagac

SEQ ID NO: 31444 - RNA, 21 nt, Artificial Sequence
  Marburg virus siRNA sense strand
auagccuugucauguuagacg

SEQ ID NO: 31445 - RNA, 21 nt, Artificial Sequence
  Marburg virus siRNA sense strand
uagccuugucauguuagacgc

SEQ ID NO: 31446 - RNA, 21 nt, Artificial Sequence
  Marburg virus siRNA sense strand
agccuugucauguuagacgcc

SEQ ID NO: 31447 - RNA, 21 nt, Artificial Sequence
  Marburg virus siRNA sense strand
gccuugucauguuagacgcca

SEQ ID NO: 31448 - RNA, 21 nt, Artificial Sequence
  Marburg virus siRNA sense strand
ccuugucauguuagacgccag

SEQ ID NO: 31449 - RNA, 21 nt, Artificial Sequence
  Marburg virus siRNA sense strand
cuugucauguuagacgccagu

SEQ ID NO: 31450 - RNA, 21 nt, Artificial Sequence
  Marburg virus siRNA sense strand
uugucauguuagacgccaguu

SEQ ID NO: 31451 - RNA, 21 nt, Artificial Sequence
  Marburg virus siRNA sense strand
ugucauguuagacgccaguua

SEQ ID NO: 31452 - RNA, 21 nt, Artificial Sequence
  Marburg virus siRNA sense strand
gucauguuagacgccaguuau

SEQ ID NO: 31453 - RNA, 21 nt, Artificial Sequence
  Marburg virus siRNA sense strand
ucauguuagacgccaguuauc

SEQ ID NO: 31454 - RNA, 21 nt, Artificial Sequence
  Marburg virus siRNA sense strand
cauguuagacgccaguuaucc

SEQ ID NO: 31455 - RNA, 21 nt, Artificial Sequence
  Marburg virus siRNA sense strand
auguuagacgccaguuaucca

SEQ ID NO: 31456 - RNA, 21 nt, Artificial Sequence
  Marburg virus siRNA sense strand
uguuagacgccaguuauccau

SEQ ID NO: 31457 - RNA, 21 nt, Artificial Sequence
  Marburg virus siRNA sense strand
guuagacgccaguuauccauc

SEQ ID NO: 31458 - RNA, 21 nt, Artificial Sequence
  Marburg virus siRNA sense strand
uuagacgccaguuauccaucu

SEQ ID NO: 31459 - RNA, 21 nt, Artificial Sequence
  Marburg virus siRNA sense strand
uagacgccaguuauccaucuu

SEQ ID NO: 31460 - RNA, 21 nt, Artificial Sequence
  Marburg virus siRNA sense strand
agacgccaguuauccaucuua

SEQ ID NO: 31461 - RNA, 21 nt, Artificial Sequence
  Marburg virus siRNA sense strand
gacgccaguuauccaucuuaa

SEQ ID NO: 31462 - RNA, 21 nt, Artificial Sequence
  Marburg virus siRNA sense strand
acgccaguuauccaucuuaag

SEQ ID NO: 31463 - RNA, 21 nt, Artificial Sequence
  Marburg virus siRNA sense strand
cgccaguuauccaucuuaagu

SEQ ID NO: 31464 - RNA, 21 nt, Artificial Sequence
  Marburg virus siRNA sense strand
gccaguuauccaucuuaagug

SEQ ID NO: 31465 - RNA, 21 nt, Artificial Sequence
  Marburg virus siRNA sense strand
ccaguuauccaucuuaaguga

SEQ ID NO: 31466 - RNA, 21 nt, Artificial Sequence
  Marburg virus siRNA sense strand
caguuauccaucuuaagugaa

SEQ ID NO: 31467 - RNA, 21 nt, Artificial Sequence
  Marburg virus siRNA sense strand
aguuauccaucuuaagugaau

SEQ ID NO: 31468 - RNA, 21 nt, Artificial Sequence
  Marburg virus siRNA sense strand
guuauccaucuuaagugaauc

SEQ ID NO: 31469 - RNA, 21 nt, Artificial Sequence
  Marburg virus siRNA sense strand
uuauccaucuuaagugaaucc

SEQ ID NO: 31470 - RNA, 21 nt, Artificial Sequence
  Marburg virus siRNA sense strand
uauccaucuuaagugaauccu

SEQ ID NO: 31471 - RNA, 21 nt, Artificial Sequence
  Marburg virus siRNA sense strand
auccaucuuaagugaauccuu

SEQ ID NO: 31472 - RNA, 21 nt, Artificial Sequence
  Marburg virus siRNA sense strand
uccaucuuaagugaauccuuu

SEQ ID NO: 31473 - RNA, 21 nt, Artificial Sequence
  Marburg virus siRNA sense strand
ccaucuuaagugaauccuuuc

SEQ ID NO: 31474 - RNA, 21 nt, Artificial Sequence
  Marburg virus siRNA sense strand
caucuuaagugaauccuuucu

SEQ ID NO: 31475 - RNA, 21 nt, Artificial Sequence
  Marburg virus siRNA sense strand
aucuuaagugaauccuuucuu

SEQ ID NO: 31476 - RNA, 21 nt, Artificial Sequence
  Marburg virus siRNA sense strand
ucuuaagugaauccuuucuuc

SEQ ID NO: 31477 - RNA, 21 nt, Artificial Sequence
  Marburg virus siRNA sense strand
cuuaagugaauccuuucuuca

SEQ ID NO: 31478 - RNA, 21 nt, Artificial Sequence
  Marburg virus siRNA sense strand
uuaagugaauccuuucuucaa

SEQ ID NO: 31479 - RNA, 21 nt, Artificial Sequence
  Marburg virus siRNA sense strand
uaagugaauccuuucuucaau

SEQ ID NO: 31480 - RNA, 21 nt, Artificial Sequence
  Marburg virus siRNA sense strand
aagugaauccuuucuucaaua

SEQ ID NO: 31481 - RNA, 21 nt, Artificial Sequence
  Marburg virus siRNA sense strand
agugaauccuuucuucaauau

SEQ ID NO: 31482 - RNA, 21 nt, Artificial Sequence
  Marburg virus siRNA sense strand
gugaauccuuucuucaauaug

SEQ ID NO: 31483 - RNA, 21 nt, Artificial Sequence
  Marburg virus siRNA sense strand
ugaauccuuucuucaauaugc

SEQ ID NO: 31484 - RNA, 21 nt, Artificial Sequence
  Marburg virus siRNA sense strand
gaauccuuucuucaauaugca

SEQ ID NO: 31485 - RNA, 21 nt, Artificial Sequence
  Marburg virus siRNA sense strand
aauccuuucuucaauaugcag

SEQ ID NO: 31486 - RNA, 21 nt, Artificial Sequence
  Marburg virus siRNA sense strand
auccuuucuucaauaugcagc

SEQ ID NO: 31487 - RNA, 21 nt, Artificial Sequence
  Marburg virus siRNA sense strand
uccuuucuucaauaugcagca

SEQ ID NO: 31488 - RNA, 21 nt, Artificial Sequence
  Marburg virus siRNA sense strand
ccuuucuucaauaugcagcau

SEQ ID NO: 31489 - RNA, 21 nt, Artificial Sequence
  Marburg virus siRNA sense strand
cuuucuucaauaugcagcauc

SEQ ID NO: 31490 - RNA, 21 nt, Artificial Sequence
  Marburg virus siRNA sense strand
uuucuucaauaugcagcaucc

SEQ ID NO: 31491 - RNA, 21 nt, Artificial Sequence
  Marburg virus siRNA sense strand
uucuucaauaugcagcaucca

SEQ ID NO: 31492 - RNA, 21 nt, Artificial Sequence
  Marburg virus siRNA sense strand
ucuucaauaugcagcauccaa

SEQ ID NO: 31493 - RNA, 21 nt, Artificial Sequence
  Marburg virus siRNA sense strand
cuucaauaugcagcauccaac

SEQ ID NO: 31494 - RNA, 21 nt, Artificial Sequence
  Marburg virus siRNA sense strand
uucaauaugcagcauccaacu

SEQ ID NO: 31495 - RNA, 21 nt, Artificial Sequence
  Marburg virus siRNA sense strand
ucaauaugcagcauccaacuc

SEQ ID NO: 31496 - RNA, 21 nt, Artificial Sequence
  Marburg virus siRNA sense strand
caauaugcagcauccaacuca

SEQ ID NO: 31497 - RNA, 21 nt, Artificial Sequence
  Marburg virus siRNA sense strand
aauaugcagcauccaacucaa

SEQ ID NO: 31498 - RNA, 21 nt, Artificial Sequence
  Marburg virus siRNA sense strand
auaugcagcauccaacucaau

SEQ ID NO: 31499 - RNA, 21 nt, Artificial Sequence
  Marburg virus siRNA sense strand
uaugcagcauccaacucaaua

SEQ ID NO: 31500 - RNA, 21 nt, Artificial Sequence
  Marburg virus siRNA sense strand
augcagcauccaacucaauau

SEQ ID NO: 31501 - RNA, 21 nt, Artificial Sequence
  Marburg virus siRNA sense strand
ugcagcauccaacucaauauc

SEQ ID NO: 31502 - RNA, 21 nt, Artificial Sequence
  Marburg virus siRNA sense strand
gcagcauccaacucaauaucc

SEQ ID NO: 31503 - RNA, 21 nt, Artificial Sequence
  Marburg virus siRNA sense strand
cagcauccaacucaauauccu

SEQ ID NO: 31504 - RNA, 21 nt, Artificial Sequence
  Marburg virus siRNA sense strand
agcauccaacucaauauccug

SEQ ID NO: 31505 - RNA, 21 nt, Artificial Sequence
  Marburg virus siRNA sense strand
gcauccaacucaauauccuga

SEQ ID NO: 31506 - RNA, 21 nt, Artificial Sequence
  Marburg virus siRNA sense strand
cauccaacucaauauccugau

SEQ ID NO: 31507 - RNA, 21 nt, Artificial Sequence
  Marburg virus siRNA sense strand
auccaacucaauauccugaug

SEQ ID NO: 31508 - RNA, 21 nt, Artificial Sequence
  Marburg virus siRNA sense strand
uccaacucaauauccugaugc

SEQ ID NO: 31509 - RNA, 21 nt, Artificial Sequence
  Marburg virus siRNA sense strand
ccaacucaauauccugaugca

SEQ ID NO: 31510 - RNA, 21 nt, Artificial Sequence
  Marburg virus siRNA sense strand
caacucaauauccugaugcaa

SEQ ID NO: 31511 - RNA, 21 nt, Artificial Sequence
  Marburg virus siRNA sense strand
aacucaauauccugaugcaag

SEQ ID NO: 31512 - RNA, 21 nt, Artificial Sequence
  Marburg virus siRNA sense strand
acucaauauccugaugcaagg

SEQ ID NO: 31513 - RNA, 21 nt, Artificial Sequence
  Marburg virus siRNA sense strand
cucaauauccugaugcaaggu

SEQ ID NO: 31514 - RNA, 21 nt, Artificial Sequence
  Marburg virus siRNA sense strand
ucaauauccugaugcaagguu

SEQ ID NO: 31515 - RNA, 21 nt, Artificial Sequence
  Marburg virus siRNA sense strand
caauauccugaugcaagguug

SEQ ID NO: 31516 - RNA, 21 nt, Artificial Sequence
  Marburg virus siRNA sense strand
aauauccugaugcaagguugu

SEQ ID NO: 31517 - RNA, 21 nt, Artificial Sequence
  Marburg virus siRNA sense strand
auauccugaugcaagguuguc

SEQ ID NO: 31518 - RNA, 21 nt, Artificial Sequence
  Marburg virus siRNA sense strand
uauccugaugcaagguugucc

SEQ ID NO: 31519 - RNA, 21 nt, Artificial Sequence
  Marburg virus siRNA sense strand
auccugaugcaagguuguccu

SEQ ID NO: 31520 - RNA, 21 nt, Artificial Sequence
  Marburg virus siRNA sense strand
uccugaugcaagguuguccuc

SEQ ID NO: 31521 - RNA, 21 nt, Artificial Sequence
  Marburg virus siRNA sense strand
ccugaugcaagguuguccucc

SEQ ID NO: 31522 - RNA, 21 nt, Artificial Sequence
  Marburg virus siRNA sense strand
cugaugcaagguuguccuccc

SEQ ID NO: 31523 - RNA, 21 nt, Artificial Sequence
  Marburg virus siRNA sense strand
ugaugcaagguuguccucccc

SEQ ID NO: 31524 - RNA, 21 nt, Artificial Sequence
  Marburg virus siRNA sense strand
gaugcaagguuguccuccccu

SEQ ID NO: 31525 - RNA, 21 nt, Artificial Sequence
  Marburg virus siRNA sense strand
augcaagguuguccuccccua

SEQ ID NO: 31526 - RNA, 21 nt, Artificial Sequence
  Marburg virus siRNA sense strand
ugcaagguuguccuccccuau

SEQ ID NO: 31527 - RNA, 21 nt, Artificial Sequence
  Marburg virus siRNA sense strand
gcaagguuguccuccccuaua

SEQ ID NO: 31528 - RNA, 21 nt, Artificial Sequence
  Marburg virus siRNA sense strand
caagguuguccuccccuauaa

SEQ ID NO: 31529 - RNA, 21 nt, Artificial Sequence
  Marburg virus siRNA sense strand
aagguuguccuccccuauaau

SEQ ID NO: 31530 - RNA, 21 nt, Artificial Sequence
  Marburg virus siRNA sense strand
agguuguccuccccuauaauc

SEQ ID NO: 31531 - RNA, 21 nt, Artificial Sequence
  Marburg virus siRNA sense strand
gguuguccuccccuauaaucc

SEQ ID NO: 31532 - RNA, 21 nt, Artificial Sequence
  Marburg virus siRNA sense strand
guuguccuccccuauaauccu

SEQ ID NO: 31533 - RNA, 21 nt, Artificial Sequence
  Marburg virus siRNA sense strand
uuguccuccccuauaauccua

SEQ ID NO: 31534 - RNA, 21 nt, Artificial Sequence
  Marburg virus siRNA sense strand
uguccuccccuauaauccuag

SEQ ID NO: 31535 - RNA, 21 nt, Artificial Sequence
  Marburg virus siRNA sense strand
guccuccccuauaauccuaga

SEQ ID NO: 31536 - RNA, 21 nt, Artificial Sequence
  Marburg virus siRNA sense strand
uccuccccuauaauccuagac

SEQ ID NO: 31537 - RNA, 21 nt, Artificial Sequence
  Marburg virus siRNA sense strand
ccuccccuauaauccuagacc

SEQ ID NO: 31538 - RNA, 21 nt, Artificial Sequence
  Marburg virus siRNA sense strand
cuccccuauaauccuagacca

SEQ ID NO: 31539 - RNA, 21 nt, Artificial Sequence
  Marburg virus siRNA sense strand
uccccuauaauccuagaccag

SEQ ID NO: 31540 - RNA, 21 nt, Artificial Sequence
  Marburg virus siRNA sense strand
ccccuauaauccuagaccagu

SEQ ID NO: 31541 - RNA, 21 nt, Artificial Sequence
  Marburg virus siRNA sense strand
cccuauaauccuagaccagug

SEQ ID NO: 31542 - RNA, 21 nt, Artificial Sequence
  Marburg virus siRNA sense strand
ccuauaauccuagaccagugu

SEQ ID NO: 31543 - RNA, 21 nt, Artificial Sequence
  Marburg virus siRNA sense strand
cuauaauccuagaccagugug

SEQ ID NO: 31544 - RNA, 21 nt, Artificial Sequence
  Marburg virus siRNA sense strand
uauaauccuagaccaguguga

SEQ ID NO: 31545 - RNA, 21 nt, Artificial Sequence
  Marburg virus siRNA sense strand
auaauccuagaccagugugac

SEQ ID NO: 31546 - RNA, 21 nt, Artificial Sequence
  Marburg virus siRNA sense strand
uaauccuagaccagugugacu

SEQ ID NO: 31547 - RNA, 21 nt, Artificial Sequence
  Marburg virus siRNA sense strand
aauccuagaccagugugacuu

SEQ ID NO: 31548 - RNA, 21 nt, Artificial Sequence
  Marburg virus siRNA sense strand
auccuagaccagugugacuua

SEQ ID NO: 31549 - RNA, 21 nt, Artificial Sequence
  Marburg virus siRNA sense strand
uccuagaccagugugacuuau

SEQ ID NO: 31550 - RNA, 21 nt, Artificial Sequence
  Marburg virus siRNA sense strand
ccuagaccagugugacuuauu

SEQ ID NO: 31551 - RNA, 21 nt, Artificial Sequence
  Marburg virus siRNA sense strand
cuagaccagugugacuuauua

SEQ ID NO: 31552 - RNA, 21 nt, Artificial Sequence
  Marburg virus siRNA sense strand
uagaccagugugacuuauuag

SEQ ID NO: 31553 - RNA, 21 nt, Artificial Sequence
  Marburg virus siRNA sense strand
agaccagugugacuuauuagc

SEQ ID NO: 31554 - RNA, 21 nt, Artificial Sequence
  Marburg virus siRNA sense strand
gaccagugugacuuauuagcc

SEQ ID NO: 31555 - RNA, 21 nt, Artificial Sequence
  Marburg virus siRNA sense strand
accagugugacuuauuagcca

SEQ ID NO: 31556 - RNA, 21 nt, Artificial Sequence
  Marburg virus siRNA sense strand
ccagugugacuuauuagccag

SEQ ID NO: 31557 - RNA, 21 nt, Artificial Sequence
  Marburg virus siRNA sense strand
cagugugacuuauuagccaga

SEQ ID NO: 31558 - RNA, 21 nt, Artificial Sequence
  Marburg virus siRNA sense strand
agugugacuuauuagccagaa

SEQ ID NO: 31559 - RNA, 21 nt, Artificial Sequence
  Marburg virus siRNA sense strand
gugugacuuauuagccagaag

SEQ ID NO: 31560 - RNA, 21 nt, Artificial Sequence
  Marburg virus siRNA sense strand
ugugacuuauuagccagaagu

SEQ ID NO: 31561 - RNA, 21 nt, Artificial Sequence
  Marburg virus siRNA sense strand
gugacuuauuagccagaaguu

SEQ ID NO: 31562 - RNA, 21 nt, Artificial Sequence
  Marburg virus siRNA sense strand
ugacuuauuagccagaaguuu

SEQ ID NO: 31563 - RNA, 21 nt, Artificial Sequence
  Marburg virus siRNA sense strand
gacuuauuagccagaaguuua

SEQ ID NO: 31564 - RNA, 21 nt, Artificial Sequence
  Marburg virus siRNA sense strand
acuuauuagccagaaguuuag

SEQ ID NO: 31565 - RNA, 21 nt, Artificial Sequence
  Marburg virus siRNA sense strand
cuuauuagccagaaguuuagg

SEQ ID NO: 31566 - RNA, 21 nt, Artificial Sequence
  Marburg virus siRNA sense strand
uuauuagccagaaguuuaggg

SEQ ID NO: 31567 - RNA, 21 nt, Artificial Sequence
  Marburg virus siRNA sense strand
uauuagccagaaguuuagggu

SEQ ID NO: 31568 - RNA, 21 nt, Artificial Sequence
  Marburg virus siRNA sense strand
auuagccagaaguuuaggguu

SEQ ID NO: 31569 - RNA, 21 nt, Artificial Sequence
  Marburg virus siRNA sense strand
uuagccagaaguuuaggguug

SEQ ID NO: 31570 - RNA, 21 nt, Artificial Sequence
  Marburg virus siRNA sense strand
uagccagaaguuuaggguugu

SEQ ID NO: 31571 - RNA, 21 nt, Artificial Sequence
  Marburg virus siRNA sense strand
agccagaaguuuaggguugua

SEQ ID NO: 31572 - RNA, 21 nt, Artificial Sequence
  Marburg virus siRNA sense strand
gccagaaguuuaggguuguau

SEQ ID NO: 31573 - RNA, 21 nt, Artificial Sequence
  Marburg virus siRNA sense strand
ccagaaguuuaggguuguaua

SEQ ID NO: 31574 - RNA, 21 nt, Artificial Sequence
  Marburg virus siRNA sense strand
cagaaguuuaggguuguauag

SEQ ID NO: 31575 - RNA, 21 nt, Artificial Sequence
  Marburg virus siRNA sense strand
agaaguuuaggguuguauagu

SEQ ID NO: 31576 - RNA, 21 nt, Artificial Sequence
  Marburg virus siRNA sense strand
gaaguuuaggguuguauaguc

SEQ ID NO: 31577 - RNA, 21 nt, Artificial Sequence
  Marburg virus siRNA sense strand
aaguuuaggguuguauaguca

SEQ ID NO: 31578 - RNA, 21 nt, Artificial Sequence
  Marburg virus siRNA sense strand
aguuuaggguuguauagucau

SEQ ID NO: 31579 - RNA, 21 nt, Artificial Sequence
  Marburg virus siRNA sense strand
guuuaggguuguauagucauu

SEQ ID NO: 31580 - RNA, 21 nt, Artificial Sequence
  Marburg virus siRNA sense strand
uuuaggguuguauagucauua

SEQ ID NO: 31581 - RNA, 21 nt, Artificial Sequence
  Marburg virus siRNA sense strand
uuaggguuguauagucauuau

SEQ ID NO: 31582 - RNA, 21 nt, Artificial Sequence
  Marburg virus siRNA sense strand
uaggguuguauagucauuauu

SEQ ID NO: 31583 - RNA, 21 nt, Artificial Sequence
  Marburg virus siRNA sense strand
aggguuguauagucauuauuc

SEQ ID NO: 31584 - RNA, 21 nt, Artificial Sequence
  Marburg virus siRNA sense strand
ggguuguauagucauuauuca

SEQ ID NO: 31585 - RNA, 21 nt, Artificial Sequence
  Marburg virus siRNA sense strand
gguuguauagucauuauucac

SEQ ID NO: 31586 - RNA, 21 nt, Artificial Sequence
  Marburg virus siRNA sense strand
guuguauagucauuauucaca

SEQ ID NO: 31587 - RNA, 21 nt, Artificial Sequence
  Marburg virus siRNA sense strand
uuguauagucauuauucacau

SEQ ID NO: 31588 - RNA, 21 nt, Artificial Sequence
  Marburg virus siRNA sense strand
uguauagucauuauucacaua

SEQ ID NO: 31589 - RNA, 21 nt, Artificial Sequence
  Marburg virus siRNA sense strand
guauagucauuauucacauaa

SEQ ID NO: 31590 - RNA, 21 nt, Artificial Sequence
  Marburg virus siRNA sense strand
uauagucauuauucacauaau

SEQ ID NO: 31591 - RNA, 21 nt, Artificial Sequence
  Marburg virus siRNA sense strand
auagucauuauucacauaauc

SEQ ID NO: 31592 - RNA, 21 nt, Artificial Sequence
  Marburg virus siRNA sense strand
uagucauuauucacauaaucc

SEQ ID NO: 31593 - RNA, 21 nt, Artificial Sequence
  Marburg virus siRNA sense strand
agucauuauucacauaauccg

SEQ ID NO: 31594 - RNA, 21 nt, Artificial Sequence
  Marburg virus siRNA sense strand
gucauuauucacauaauccga

SEQ ID NO: 31595 - RNA, 21 nt, Artificial Sequence
  Marburg virus siRNA sense strand
ucauuauucacauaauccgaa

SEQ ID NO: 31596 - RNA, 21 nt, Artificial Sequence
  Marburg virus siRNA sense strand
cauuauucacauaauccgaaa

SEQ ID NO: 31597 - RNA, 21 nt, Artificial Sequence
  Marburg virus siRNA sense strand
auuauucacauaauccgaaau

SEQ ID NO: 31598 - RNA, 21 nt, Artificial Sequence
  Marburg virus siRNA sense strand
uuauucacauaauccgaaauu

SEQ ID NO: 31599 - RNA, 21 nt, Artificial Sequence
  Marburg virus siRNA sense strand
uauucacauaauccgaaauug

SEQ ID NO: 31600 - RNA, 21 nt, Artificial Sequence
  Marburg virus siRNA sense strand
auucacauaauccgaaauugc

SEQ ID NO: 31601 - RNA, 21 nt, Artificial Sequence
  Marburg virus siRNA sense strand
uucacauaauccgaaauugcg

SEQ ID NO: 31602 - RNA, 21 nt, Artificial Sequence
  Marburg virus siRNA sense strand
ucacauaauccgaaauugcgu

SEQ ID NO: 31603 - RNA, 21 nt, Artificial Sequence
  Marburg virus siRNA sense strand
cacauaauccgaaauugcgua

SEQ ID NO: 31604 - RNA, 21 nt, Artificial Sequence
  Marburg virus siRNA sense strand
acauaauccgaaauugcguaa

SEQ ID NO: 31605 - RNA, 21 nt, Artificial Sequence
  Marburg virus siRNA sense strand
cauaauccgaaauugcguaau

SEQ ID NO: 31606 - RNA, 21 nt, Artificial Sequence
  Marburg virus siRNA sense strand
auaauccgaaauugcguaauu

SEQ ID NO: 31607 - RNA, 21 nt, Artificial Sequence
  Marburg virus siRNA sense strand
uaauccgaaauugcguaauug

SEQ ID NO: 31608 - RNA, 21 nt, Artificial Sequence
  Marburg virus siRNA sense strand
aauccgaaauugcguaauugu

SEQ ID NO: 31609 - RNA, 21 nt, Artificial Sequence
  Marburg virus siRNA sense strand
auccgaaauugcguaauugua

SEQ ID NO: 31610 - RNA, 21 nt, Artificial Sequence
  Marburg virus siRNA sense strand
uccgaaauugcguaauuguag

SEQ ID NO: 31611 - RNA, 21 nt, Artificial Sequence
  Marburg virus siRNA sense strand
ccgaaauugcguaauuguagg

SEQ ID NO: 31612 - RNA, 21 nt, Artificial Sequence
  Marburg virus siRNA sense strand
cgaaauugcguaauuguagga

SEQ ID NO: 31613 - RNA, 21 nt, Artificial Sequence
  Marburg virus siRNA sense strand
gaaauugcguaauuguaggau

SEQ ID NO: 31614 - RNA, 21 nt, Artificial Sequence
  Marburg virus siRNA sense strand
aaauugcguaauuguaggauu

SEQ ID NO: 31615 - RNA, 21 nt, Artificial Sequence
  Marburg virus siRNA sense strand
aauugcguaauuguaggauuc

SEQ ID NO: 31616 - RNA, 21 nt, Artificial Sequence
  Marburg virus siRNA sense strand
auugcguaauuguaggauucc

SEQ ID NO: 31617 - RNA, 21 nt, Artificial Sequence
  Marburg virus siRNA sense strand
uugcguaauuguaggauucca

SEQ ID NO: 31618 - RNA, 21 nt, Artificial Sequence
  Marburg virus siRNA sense strand
ugcguaauuguaggauuccac

SEQ ID NO: 31619 - RNA, 21 nt, Artificial Sequence
  Marburg virus siRNA sense strand
gcguaauuguaggauuccaca

SEQ ID NO: 31620 - RNA, 21 nt, Artificial Sequence
  Marburg virus siRNA sense strand
cguaauuguaggauuccacau

SEQ ID NO: 31621 - RNA, 21 nt, Artificial Sequence
  Marburg virus siRNA sense strand
guaauuguaggauuccacauc

SEQ ID NO: 31622 - RNA, 21 nt, Artificial Sequence
  Marburg virus siRNA sense strand
uaauuguaggauuccacauca

SEQ ID NO: 31623 - RNA, 21 nt, Artificial Sequence
  Marburg virus siRNA sense strand
aauuguaggauuccacaucau

SEQ ID NO: 31624 - RNA, 21 nt, Artificial Sequence
  Marburg virus siRNA sense strand
auuguaggauuccacaucaua

SEQ ID NO: 31625 - RNA, 21 nt, Artificial Sequence
  Marburg virus siRNA sense strand
uuguaggauuccacaucauau

SEQ ID NO: 31626 - RNA, 21 nt, Artificial Sequence
  Marburg virus siRNA sense strand
uguaggauuccacaucauauu

SEQ ID NO: 31627 - RNA, 21 nt, Artificial Sequence
  Marburg virus siRNA sense strand
guaggauuccacaucauauuu

SEQ ID NO: 31628 - RNA, 21 nt, Artificial Sequence
  Marburg virus siRNA sense strand
uaggauuccacaucauauuua

SEQ ID NO: 31629 - RNA, 21 nt, Artificial Sequence
  Marburg virus siRNA sense strand
aggauuccacaucauauuuac

SEQ ID NO: 31630 - RNA, 21 nt, Artificial Sequence
  Marburg virus siRNA sense strand
ggauuccacaucauauuuacc

SEQ ID NO: 31631 - RNA, 21 nt, Artificial Sequence
  Marburg virus siRNA sense strand
gauuccacaucauauuuaccg

SEQ ID NO: 31632 - RNA, 21 nt, Artificial Sequence
  Marburg virus siRNA sense strand
auuccacaucauauuuaccgu

SEQ ID NO: 31633 - RNA, 21 nt, Artificial Sequence
  Marburg virus siRNA sense strand
uuccacaucauauuuaccguu

SEQ ID NO: 31634 - RNA, 21 nt, Artificial Sequence
  Marburg virus siRNA sense strand
uccacaucauauuuaccguuu

SEQ ID NO: 31635 - RNA, 21 nt, Artificial Sequence
  Marburg virus siRNA sense strand
ccacaucauauuuaccguuua

SEQ ID NO: 31636 - RNA, 21 nt, Artificial Sequence
  Marburg virus siRNA sense strand
cacaucauauuuaccguuuaa

SEQ ID NO: 31637 - RNA, 21 nt, Artificial Sequence
  Marburg virus siRNA sense strand
acaucauauuuaccguuuaag

SEQ ID NO: 31638 - RNA, 21 nt, Artificial Sequence
  Marburg virus siRNA sense strand
caucauauuuaccguuuaagg

SEQ ID NO: 31639 - RNA, 21 nt, Artificial Sequence
  Marburg virus siRNA sense strand
aucauauuuaccguuuaagga

SEQ ID NO: 31640 - RNA, 21 nt, Artificial Sequence
  Marburg virus siRNA sense strand
ucauauuuaccguuuaaggaa

SEQ ID NO: 31641 - RNA, 21 nt, Artificial Sequence
  Marburg virus siRNA sense strand
cauauuuaccguuuaaggaau

SEQ ID NO: 31642 - RNA, 21 nt, Artificial Sequence
  Marburg virus siRNA sense strand
auauuuaccguuuaaggaauu

SEQ ID NO: 31643 - RNA, 21 nt, Artificial Sequence
  Marburg virus siRNA sense strand
uauuuaccguuuaaggaauuc

SEQ ID NO: 31644 - RNA, 21 nt, Artificial Sequence
  Marburg virus siRNA sense strand
auuuaccguuuaaggaauucg

SEQ ID NO: 31645 - RNA, 21 nt, Artificial Sequence
  Marburg virus siRNA sense strand
uuuaccguuuaaggaauucga

SEQ ID NO: 31646 - RNA, 21 nt, Artificial Sequence
  Marburg virus siRNA sense strand
uuaccguuuaaggaauucgac

SEQ ID NO: 31647 - RNA, 21 nt, Artificial Sequence
  Marburg virus siRNA sense strand
uaccguuuaaggaauucgaca

SEQ ID NO: 31648 - RNA, 21 nt, Artificial Sequence
  Marburg virus siRNA sense strand
accguuuaaggaauucgacag

SEQ ID NO: 31649 - RNA, 21 nt, Artificial Sequence
  Marburg virus siRNA sense strand
ccguuuaaggaauucgacagc

SEQ ID NO: 31650 - RNA, 21 nt, Artificial Sequence
  Marburg virus siRNA sense strand
cguuuaaggaauucgacagca

SEQ ID NO: 31651 - RNA, 21 nt, Artificial Sequence
  Marburg virus siRNA sense strand
guuuaaggaauucgacagcau

SEQ ID NO: 31652 - RNA, 21 nt, Artificial Sequence
  Marburg virus siRNA sense strand
uuuaaggaauucgacagcauu

SEQ ID NO: 31653 - RNA, 21 nt, Artificial Sequence
  Marburg virus siRNA sense strand
uuaaggaauucgacagcauua

SEQ ID NO: 31654 - RNA, 21 nt, Artificial Sequence
  Marburg virus siRNA sense strand
uaaggaauucgacagcauuaa

SEQ ID NO: 31655 - RNA, 21 nt, Artificial Sequence
  Marburg virus siRNA sense strand
aaggaauucgacagcauuaaa

SEQ ID NO: 31656 - RNA, 21 nt, Artificial Sequence
  Marburg virus siRNA sense strand
aggaauucgacagcauuaaaa

SEQ ID NO: 31657 - RNA, 21 nt, Artificial Sequence
  Marburg virus siRNA sense strand
ggaauucgacagcauuaaaaa

SEQ ID NO: 31658 - RNA, 21 nt, Artificial Sequence
  Marburg virus siRNA sense strand
gaauucgacagcauuaaaaac

SEQ ID NO: 31659 - RNA, 21 nt, Artificial Sequence
  Marburg virus siRNA sense strand
aauucgacagcauuaaaaaca

SEQ ID NO: 31660 - RNA, 21 nt, Artificial Sequence
  Marburg virus siRNA sense strand
auucgacagcauuaaaaacau

SEQ ID NO: 31661 - RNA, 21 nt, Artificial Sequence
  Marburg virus siRNA sense strand
uucgacagcauuaaaaacauu

SEQ ID NO: 31662 - RNA, 21 nt, Artificial Sequence
  Marburg virus siRNA sense strand
ucgacagcauuaaaaacauuu

SEQ ID NO: 31663 - RNA, 21 nt, Artificial Sequence
  Marburg virus siRNA sense strand
cgacagcauuaaaaacauuuc

SEQ ID NO: 31664 - RNA, 21 nt, Artificial Sequence
  Marburg virus siRNA sense strand
gacagcauuaaaaacauuucu

SEQ ID NO: 31665 - RNA, 21 nt, Artificial Sequence
  Marburg virus siRNA sense strand
acagcauuaaaaacauuucuu

SEQ ID NO: 31666 - RNA, 21 nt, Artificial Sequence
  Marburg virus siRNA sense strand
cagcauuaaaaacauuucuuc

SEQ ID NO: 31667 - RNA, 21 nt, Artificial Sequence
  Marburg virus siRNA sense strand
agcauuaaaaacauuucuuca

SEQ ID NO: 31668 - RNA, 21 nt, Artificial Sequence
  Marburg virus siRNA sense strand
gcauuaaaaacauuucuucag

SEQ ID NO: 31669 - RNA, 21 nt, Artificial Sequence
  Marburg virus siRNA sense strand
cauuaaaaacauuucuucaga

SEQ ID NO: 31670 - RNA, 21 nt, Artificial Sequence
  Marburg virus siRNA sense strand
auuaaaaacauuucuucagaa

SEQ ID NO: 31671 - RNA, 21 nt, Artificial Sequence
  Marburg virus siRNA sense strand
uuaaaaacauuucuucagaac

SEQ ID NO: 31672 - RNA, 21 nt, Artificial Sequence
  Marburg virus siRNA sense strand
uaaaaacauuucuucagaacu

SEQ ID NO: 31673 - RNA, 21 nt, Artificial Sequence
  Marburg virus siRNA sense strand
aaaaacauuucuucagaacug

SEQ ID NO: 31674 - RNA, 21 nt, Artificial Sequence
  Marburg virus siRNA sense strand
aaaacauuucuucagaacugu

SEQ ID NO: 31675 - RNA, 21 nt, Artificial Sequence
  Marburg virus siRNA sense strand
aaacauuucuucagaacuguu

SEQ ID NO: 31676 - RNA, 21 nt, Artificial Sequence
  Marburg virus siRNA sense strand
aacauuucuucagaacuguuc

SEQ ID NO: 31677 - RNA, 21 nt, Artificial Sequence
  Marburg virus siRNA sense strand
acauuucuucagaacuguuca

SEQ ID NO: 31678 - RNA, 21 nt, Artificial Sequence
  Marburg virus siRNA sense strand
cauuucuucagaacuguucaa

SEQ ID NO: 31679 - RNA, 21 nt, Artificial Sequence
  Marburg virus siRNA sense strand
auuucuucagaacuguucaau

SEQ ID NO: 31680 - RNA, 21 nt, Artificial Sequence
  Marburg virus siRNA sense strand
uuucuucagaacuguucaaua

SEQ ID NO: 31681 - RNA, 21 nt, Artificial Sequence
  Marburg virus siRNA sense strand
uucuucagaacuguucaauac

SEQ ID NO: 31682 - RNA, 21 nt, Artificial Sequence
  Marburg virus siRNA sense strand
ucuucagaacuguucaauacu

SEQ ID NO: 31683 - RNA, 21 nt, Artificial Sequence
  Marburg virus siRNA sense strand
cuucagaacuguucaauacuc

SEQ ID NO: 31684 - RNA, 21 nt, Artificial Sequence
  Marburg virus siRNA sense strand
uucagaacuguucaauacuca

SEQ ID NO: 31685 - RNA, 21 nt, Artificial Sequence
  Marburg virus siRNA sense strand
ucagaacuguucaauacucac

SEQ ID NO: 31686 - RNA, 21 nt, Artificial Sequence
  Marburg virus siRNA sense strand
cagaacuguucaauacucacc

SEQ ID NO: 31687 - RNA, 21 nt, Artificial Sequence
  Marburg virus siRNA sense strand
agaacuguucaauacucaccg

SEQ ID NO: 31688 - RNA, 21 nt, Artificial Sequence
  Marburg virus siRNA sense strand
gaacuguucaauacucaccgu

SEQ ID NO: 31689 - RNA, 21 nt, Artificial Sequence
  Marburg virus siRNA sense strand
aacuguucaauacucaccguc

SEQ ID NO: 31690 - RNA, 21 nt, Artificial Sequence
  Marburg virus siRNA sense strand
acuguucaauacucaccgucc

SEQ ID NO: 31691 - RNA, 21 nt, Artificial Sequence
  Marburg virus siRNA sense strand
cuguucaauacucaccguccc

SEQ ID NO: 31692 - RNA, 21 nt, Artificial Sequence
  Marburg virus siRNA sense strand
uguucaauacucaccgucccu

SEQ ID NO: 31693 - RNA, 21 nt, Artificial Sequence
  Marburg virus siRNA sense strand
guucaauacucaccgucccuu

SEQ ID NO: 31694 - RNA, 21 nt, Artificial Sequence
  Marburg virus siRNA sense strand
uucaauacucaccgucccuuu

SEQ ID NO: 31695 - RNA, 21 nt, Artificial Sequence
  Marburg virus siRNA sense strand
ucaauacucaccgucccuuuu

SEQ ID NO: 31696 - RNA, 21 nt, Artificial Sequence
  Marburg virus siRNA sense strand
caauacucaccgucccuuuuc

SEQ ID NO: 31697 - RNA, 21 nt, Artificial Sequence
  Marburg virus siRNA sense strand
aauacucaccgucccuuuuca

SEQ ID NO: 31698 - RNA, 21 nt, Artificial Sequence
  Marburg virus siRNA sense strand
auacucaccgucccuuuucau

SEQ ID NO: 31699 - RNA, 21 nt, Artificial Sequence
  Marburg virus siRNA sense strand
uacucaccgucccuuuucauu

SEQ ID NO: 31700 - RNA, 21 nt, Artificial Sequence
  Marburg virus siRNA sense strand
acucaccgucccuuuucauuc

SEQ ID NO: 31701 - RNA, 21 nt, Artificial Sequence
  Marburg virus siRNA sense strand
cucaccgucccuuuucauuca

SEQ ID NO: 31702 - RNA, 21 nt, Artificial Sequence
  Marburg virus siRNA sense strand
ucaccgucccuuuucauucaa

SEQ ID NO: 31703 - RNA, 21 nt, Artificial Sequence
  Marburg virus siRNA sense strand
caccgucccuuuucauucaau

SEQ ID NO: 31704 - RNA, 21 nt, Artificial Sequence
  Marburg virus siRNA sense strand
accgucccuuuucauucaauc

SEQ ID NO: 31705 - RNA, 21 nt, Artificial Sequence
  Marburg virus siRNA sense strand
ccgucccuuuucauucaaucu

SEQ ID NO: 31706 - RNA, 21 nt, Artificial Sequence
  Marburg virus siRNA sense strand
cgucccuuuucauucaaucug

SEQ ID NO: 31707 - RNA, 21 nt, Artificial Sequence
  Marburg virus siRNA sense strand
gucccuuuucauucaaucugg

SEQ ID NO: 31708 - RNA, 21 nt, Artificial Sequence
  Marburg virus siRNA sense strand
ucccuuuucauucaaucuggg

SEQ ID NO: 31709 - RNA, 21 nt, Artificial Sequence
  Marburg virus siRNA sense strand
cccuuuucauucaaucuggga

SEQ ID NO: 31710 - RNA, 21 nt, Artificial Sequence
  Marburg virus siRNA sense strand
ccuuuucauucaaucugggau

SEQ ID NO: 31711 - RNA, 21 nt, Artificial Sequence
  Marburg virus siRNA sense strand
cuuuucauucaaucugggauc

SEQ ID NO: 31712 - RNA, 21 nt, Artificial Sequence
  Marburg virus siRNA sense strand
uuuucauucaaucugggauca

SEQ ID NO: 31713 - RNA, 21 nt, Artificial Sequence
  Marburg virus siRNA sense strand
uuucauucaaucugggaucau

SEQ ID NO: 31714 - RNA, 21 nt, Artificial Sequence
  Marburg virus siRNA sense strand
uucauucaaucugggaucaua

SEQ ID NO: 31715 - RNA, 21 nt, Artificial Sequence
  Marburg virus siRNA sense strand
ucauucaaucugggaucauau

SEQ ID NO: 31716 - RNA, 21 nt, Artificial Sequence
  Marburg virus siRNA sense strand
cauucaaucugggaucauauu

SEQ ID NO: 31717 - RNA, 21 nt, Artificial Sequence
  Marburg virus siRNA sense strand
auucaaucugggaucauauuu

SEQ ID NO: 31718 - RNA, 21 nt, Artificial Sequence
  Marburg virus siRNA sense strand
uucaaucugggaucauauuuu

SEQ ID NO: 31719 - RNA, 21 nt, Artificial Sequence
  Marburg virus siRNA sense strand
ucaaucugggaucauauuuua

SEQ ID NO: 31720 - RNA, 21 nt, Artificial Sequence
  Marburg virus siRNA sense strand
caaucugggaucauauuuuaa

SEQ ID NO: 31721 - RNA, 21 nt, Artificial Sequence
  Marburg virus siRNA sense strand
aaucugggaucauauuuuaac

SEQ ID NO: 31722 - RNA, 21 nt, Artificial Sequence
  Marburg virus siRNA sense strand
aucugggaucauauuuuaacu

SEQ ID NO: 31723 - RNA, 21 nt, Artificial Sequence
  Marburg virus siRNA sense strand
ucugggaucauauuuuaacuu

SEQ ID NO: 31724 - RNA, 21 nt, Artificial Sequence
  Marburg virus siRNA sense strand
cugggaucauauuuuaacuuc

SEQ ID NO: 31725 - RNA, 21 nt, Artificial Sequence
  Marburg virus siRNA sense strand
ugggaucauauuuuaacuucc

SEQ ID NO: 31726 - RNA, 21 nt, Artificial Sequence
  Marburg virus siRNA sense strand
gggaucauauuuuaacuucca

SEQ ID NO: 31727 - RNA, 21 nt, Artificial Sequence
  Marburg virus siRNA sense strand
ggaucauauuuuaacuuccau

SEQ ID NO: 31728 - RNA, 21 nt, Artificial Sequence
  Marburg virus siRNA sense strand
gaucauauuuuaacuuccauu

SEQ ID NO: 31729 - RNA, 21 nt, Artificial Sequence
  Marburg virus siRNA sense strand
aucauauuuuaacuuccauuc

SEQ ID NO: 31730 - RNA, 21 nt, Artificial Sequence
  Marburg virus siRNA sense strand
ucauauuuuaacuuccauuca

SEQ ID NO: 31731 - RNA, 21 nt, Artificial Sequence
  Marburg virus siRNA sense strand
cauauuuuaacuuccauucaa

SEQ ID NO: 31732 - RNA, 21 nt, Artificial Sequence
  Marburg virus siRNA sense strand
auauuuuaacuuccauucaau

SEQ ID NO: 31733 - RNA, 21 nt, Artificial Sequence
  Marburg virus siRNA sense strand
uauuuuaacuuccauucaaua

SEQ ID NO: 31734 - RNA, 21 nt, Artificial Sequence
  Marburg virus siRNA sense strand
auuuuaacuuccauucaauau

SEQ ID NO: 31735 - RNA, 21 nt, Artificial Sequence
  Marburg virus siRNA sense strand
uuuuaacuuccauucaauaug

SEQ ID NO: 31736 - RNA, 21 nt, Artificial Sequence
  Marburg virus siRNA sense strand
uuuaacuuccauucaauauga

SEQ ID NO: 31737 - RNA, 21 nt, Artificial Sequence
  Marburg virus siRNA sense strand
uuaacuuccauucaauaugau

SEQ ID NO: 31738 - RNA, 21 nt, Artificial Sequence
  Marburg virus siRNA sense strand
uaacuuccauucaauaugaug

SEQ ID NO: 31739 - RNA, 21 nt, Artificial Sequence
  Marburg virus siRNA sense strand
aacuuccauucaauaugaugc

SEQ ID NO: 31740 - RNA, 21 nt, Artificial Sequence
  Marburg virus siRNA sense strand
acuuccauucaauaugaugca

SEQ ID NO: 31741 - RNA, 21 nt, Artificial Sequence
  Marburg virus siRNA sense strand
cuuccauucaauaugaugcaa

SEQ ID NO: 31742 - RNA, 21 nt, Artificial Sequence
  Marburg virus siRNA sense strand
uuccauucaauaugaugcaau

SEQ ID NO: 31743 - RNA, 21 nt, Artificial Sequence
  Marburg virus siRNA sense strand
uccauucaauaugaugcaauu

SEQ ID NO: 31744 - RNA, 21 nt, Artificial Sequence
  Marburg virus siRNA sense strand
ccauucaauaugaugcaauua

SEQ ID NO: 31745 - RNA, 21 nt, Artificial Sequence
  Marburg virus siRNA sense strand
cauucaauaugaugcaauuaa

SEQ ID NO: 31746 - RNA, 21 nt, Artificial Sequence
  Marburg virus siRNA sense strand
auucaauaugaugcaauuaau

SEQ ID NO: 31747 - RNA, 21 nt, Artificial Sequence
  Marburg virus siRNA sense strand
uucaauaugaugcaauuaauc

SEQ ID NO: 31748 - RNA, 21 nt, Artificial Sequence
  Marburg virus siRNA sense strand
ucaauaugaugcaauuaauca

SEQ ID NO: 31749 - RNA, 21 nt, Artificial Sequence
  Marburg virus siRNA sense strand
caauaugaugcaauuaaucau

SEQ ID NO: 31750 - RNA, 21 nt, Artificial Sequence
  Marburg virus siRNA sense strand
aauaugaugcaauuaaucaug

SEQ ID NO: 31751 - RNA, 21 nt, Artificial Sequence
  Marburg virus siRNA sense strand
auaugaugcaauuaaucaugu

SEQ ID NO: 31752 - RNA, 21 nt, Artificial Sequence
  Marburg virus siRNA sense strand
uaugaugcaauuaaucauguu

SEQ ID NO: 31753 - RNA, 21 nt, Artificial Sequence
  Marburg virus siRNA sense strand
augaugcaauuaaucauguug

SEQ ID NO: 31754 - RNA, 21 nt, Artificial Sequence
  Marburg virus siRNA sense strand
ugaugcaauuaaucauguuga

SEQ ID NO: 31755 - RNA, 21 nt, Artificial Sequence
  Marburg virus siRNA sense strand
gaugcaauuaaucauguugau

SEQ ID NO: 31756 - RNA, 21 nt, Artificial Sequence
  Marburg virus siRNA sense strand
augcaauuaaucauguugaug

SEQ ID NO: 31757 - RNA, 21 nt, Artificial Sequence
  Marburg virus siRNA sense strand
ugcaauuaaucauguugauga

SEQ ID NO: 31758 - RNA, 21 nt, Artificial Sequence
  Marburg virus siRNA sense strand
gcaauuaaucauguugaugau

SEQ ID NO: 31759 - RNA, 21 nt, Artificial Sequence
  Marburg virus siRNA sense strand
caauuaaucauguugaugauu

SEQ ID NO: 31760 - RNA, 21 nt, Artificial Sequence
  Marburg virus siRNA sense strand
aauuaaucauguugaugauuu

SEQ ID NO: 31761 - RNA, 21 nt, Artificial Sequence
  Marburg virus siRNA sense strand
auuaaucauguugaugauuuu

SEQ ID NO: 31762 - RNA, 21 nt, Artificial Sequence
  Marburg virus siRNA sense strand
uuaaucauguugaugauuuua

SEQ ID NO: 31763 - RNA, 21 nt, Artificial Sequence
  Marburg virus siRNA sense strand
uaaucauguugaugauuuuaa

SEQ ID NO: 31764 - RNA, 21 nt, Artificial Sequence
  Marburg virus siRNA sense strand
aaucauguugaugauuuuaaa

SEQ ID NO: 31765 - RNA, 21 nt, Artificial Sequence
  Marburg virus siRNA sense strand
aucauguugaugauuuuaaau

SEQ ID NO: 31766 - RNA, 21 nt, Artificial Sequence
  Marburg virus siRNA sense strand
ucauguugaugauuuuaaaua

SEQ ID NO: 31767 - RNA, 21 nt, Artificial Sequence
  Marburg virus siRNA sense strand
cauguugaugauuuuaaauac

SEQ ID NO: 31768 - RNA, 21 nt, Artificial Sequence
  Marburg virus siRNA sense strand
auguugaugauuuuaaauacc

SEQ ID NO: 31769 - RNA, 21 nt, Artificial Sequence
  Marburg virus siRNA sense strand
uguugaugauuuuaaauaccu

SEQ ID NO: 31770 - RNA, 21 nt, Artificial Sequence
  Marburg virus siRNA sense strand
guugaugauuuuaaauaccua

SEQ ID NO: 31771 - RNA, 21 nt, Artificial Sequence
  Marburg virus siRNA sense strand
uugaugauuuuaaauaccuau

SEQ ID NO: 31772 - RNA, 21 nt, Artificial Sequence
  Marburg virus siRNA sense strand
ugaugauuuuaaauaccuauu

SEQ ID NO: 31773 - RNA, 21 nt, Artificial Sequence
  Marburg virus siRNA sense strand
gaugauuuuaaauaccuauug

SEQ ID NO: 31774 - RNA, 21 nt, Artificial Sequence
  Marburg virus siRNA sense strand
augauuuuaaauaccuauugc

SEQ ID NO: 31775 - RNA, 21 nt, Artificial Sequence
  Marburg virus siRNA sense strand
ugauuuuaaauaccuauugcc

SEQ ID NO: 31776 - RNA, 21 nt, Artificial Sequence
  Marburg virus siRNA sense strand
gauuuuaaauaccuauugccc

SEQ ID NO: 31777 - RNA, 21 nt, Artificial Sequence
  Marburg virus siRNA sense strand
auuuuaaauaccuauugcccu

SEQ ID NO: 31778 - RNA, 21 nt, Artificial Sequence
  Marburg virus siRNA sense strand
uuuuaaauaccuauugcccuc

SEQ ID NO: 31779 - RNA, 21 nt, Artificial Sequence
  Marburg virus siRNA sense strand
uuuaaauaccuauugcccucu

SEQ ID NO: 31780 - RNA, 21 nt, Artificial Sequence
  Marburg virus siRNA sense strand
uuaaauaccuauugcccucug

SEQ ID NO: 31781 - RNA, 21 nt, Artificial Sequence
  Marburg virus siRNA sense strand
uaaauaccuauugcccucuga

SEQ ID NO: 31782 - RNA, 21 nt, Artificial Sequence
  Marburg virus siRNA sense strand
aaauaccuauugcccucugag

SEQ ID NO: 31783 - RNA, 21 nt, Artificial Sequence
  Marburg virus siRNA sense strand
aauaccuauugcccucugagc

SEQ ID NO: 31784 - RNA, 21 nt, Artificial Sequence
  Marburg virus siRNA sense strand
auaccuauugcccucugagcu

SEQ ID NO: 31785 - RNA, 21 nt, Artificial Sequence
  Marburg virus siRNA sense strand
uaccuauugcccucugagcua

SEQ ID NO: 31786 - RNA, 21 nt, Artificial Sequence
  Marburg virus siRNA sense strand
accuauugcccucugagcuag

SEQ ID NO: 31787 - RNA, 21 nt, Artificial Sequence
  Marburg virus siRNA sense strand
ccuauugcccucugagcuagu

SEQ ID NO: 31788 - RNA, 21 nt, Artificial Sequence
  Marburg virus siRNA sense strand
cuauugcccucugagcuaguc

SEQ ID NO: 31789 - RNA, 21 nt, Artificial Sequence
  Marburg virus siRNA sense strand
uauugcccucugagcuaguca

SEQ ID NO: 31790 - RNA, 21 nt, Artificial Sequence
  Marburg virus siRNA sense strand
auugcccucugagcuagucaa

SEQ ID NO: 31791 - RNA, 21 nt, Artificial Sequence
  Marburg virus siRNA sense strand
uugcccucugagcuagucaag

SEQ ID NO: 31792 - RNA, 21 nt, Artificial Sequence
  Marburg virus siRNA sense strand
ugcccucugagcuagucaagu

SEQ ID NO: 31793 - RNA, 21 nt, Artificial Sequence
  Marburg virus siRNA sense strand
gcccucugagcuagucaagua

SEQ ID NO: 31794 - RNA, 21 nt, Artificial Sequence
  Marburg virus siRNA sense strand
cccucugagcuagucaaguau

SEQ ID NO: 31795 - RNA, 21 nt, Artificial Sequence
  Marburg virus siRNA sense strand
ccucugagcuagucaaguaug

SEQ ID NO: 31796 - RNA, 21 nt, Artificial Sequence
  Marburg virus siRNA sense strand
cucugagcuagucaaguaugc

SEQ ID NO: 31797 - RNA, 21 nt, Artificial Sequence
  Marburg virus siRNA sense strand
ucugagcuagucaaguaugca

SEQ ID NO: 31798 - RNA, 21 nt, Artificial Sequence
  Marburg virus siRNA sense strand
cugagcuagucaaguaugcaa

SEQ ID NO: 31799 - RNA, 21 nt, Artificial Sequence
  Marburg virus siRNA sense strand
ugagcuagucaaguaugcaaa

SEQ ID NO: 31800 - RNA, 21 nt, Artificial Sequence
  Marburg virus siRNA sense strand
gagcuagucaaguaugcaaau

SEQ ID NO: 31801 - RNA, 21 nt, Artificial Sequence
  Marburg virus siRNA sense strand
agcuagucaaguaugcaaauu

SEQ ID NO: 31802 - RNA, 21 nt, Artificial Sequence
  Marburg virus siRNA sense strand
gcuagucaaguaugcaaauug

SEQ ID NO: 31803 - RNA, 21 nt, Artificial Sequence
  Marburg virus siRNA sense strand
cuagucaaguaugcaaauugg

SEQ ID NO: 31804 - RNA, 21 nt, Artificial Sequence
  Marburg virus siRNA sense strand
uagucaaguaugcaaauuggg

SEQ ID NO: 31805 - RNA, 21 nt, Artificial Sequence
  Marburg virus siRNA sense strand
agucaaguaugcaaauuggga

SEQ ID NO: 31806 - RNA, 21 nt, Artificial Sequence
  Marburg virus siRNA sense strand
gucaaguaugcaaauugggac

SEQ ID NO: 31807 - RNA, 21 nt, Artificial Sequence
  Marburg virus siRNA sense strand
ucaaguaugcaaauugggaca

SEQ ID NO: 31808 - RNA, 21 nt, Artificial Sequence
  Marburg virus siRNA sense strand
caaguaugcaaauugggacaa

SEQ ID NO: 31809 - RNA, 21 nt, Artificial Sequence
  Marburg virus siRNA sense strand
aaguaugcaaauugggacaac

SEQ ID NO: 31810 - RNA, 21 nt, Artificial Sequence
  Marburg virus siRNA sense strand
aguaugcaaauugggacaacg

SEQ ID NO: 31811 - RNA, 21 nt, Artificial Sequence
  Marburg virus siRNA sense strand
guaugcaaauugggacaacga

SEQ ID NO: 31812 - RNA, 21 nt, Artificial Sequence
  Marburg virus siRNA sense strand
uaugcaaauugggacaacgag

SEQ ID NO: 31813 - RNA, 21 nt, Artificial Sequence
  Marburg virus siRNA sense strand
augcaaauugggacaacgagu

SEQ ID NO: 31814 - RNA, 21 nt, Artificial Sequence
  Marburg virus siRNA sense strand
ugcaaauugggacaacgaguu

SEQ ID NO: 31815 - RNA, 21 nt, Artificial Sequence
  Marburg virus siRNA sense strand
gcaaauugggacaacgaguuc

SEQ ID NO: 31816 - RNA, 21 nt, Artificial Sequence
  Marburg virus siRNA sense strand
caaauugggacaacgaguucu

SEQ ID NO: 31817 - RNA, 21 nt, Artificial Sequence
  Marburg virus siRNA sense strand
aaauugggacaacgaguucuu

SEQ ID NO: 31818 - RNA, 21 nt, Artificial Sequence
  Marburg virus siRNA sense strand
aauugggacaacgaguucuug

SEQ ID NO: 31819 - RNA, 21 nt, Artificial Sequence
  Marburg virus siRNA sense strand
auugggacaacgaguucuuga

SEQ ID NO: 31820 - RNA, 21 nt, Artificial Sequence
  Marburg virus siRNA sense strand
uugggacaacgaguucuugaa

SEQ ID NO: 31821 - RNA, 21 nt, Artificial Sequence
  Marburg virus siRNA sense strand
ugggacaacgaguucuugaag

SEQ ID NO: 31822 - RNA, 21 nt, Artificial Sequence
  Marburg virus siRNA sense strand
gggacaacgaguucuugaagg

SEQ ID NO: 31823 - RNA, 21 nt, Artificial Sequence
  Marburg virus siRNA sense strand
ggacaacgaguucuugaaggc

SEQ ID NO: 31824 - RNA, 21 nt, Artificial Sequence
  Marburg virus siRNA sense strand
gacaacgaguucuugaaggca

SEQ ID NO: 31825 - RNA, 21 nt, Artificial Sequence
  Marburg virus siRNA sense strand
acaacgaguucuugaaggcau

SEQ ID NO: 31826 - RNA, 21 nt, Artificial Sequence
  Marburg virus siRNA sense strand
caacgaguucuugaaggcaua

SEQ ID NO: 31827 - RNA, 21 nt, Artificial Sequence
  Marburg virus siRNA sense strand
aacgaguucuugaaggcauau

SEQ ID NO: 31828 - RNA, 21 nt, Artificial Sequence
  Marburg virus siRNA sense strand
acgaguucuugaaggcauauc

SEQ ID NO: 31829 - RNA, 21 nt, Artificial Sequence
  Marburg virus siRNA sense strand
cgaguucuugaaggcauaucu

SEQ ID NO: 31830 - RNA, 21 nt, Artificial Sequence
  Marburg virus siRNA sense strand
gaguucuugaaggcauaucuu

SEQ ID NO: 31831 - RNA, 21 nt, Artificial Sequence
  Marburg virus siRNA sense strand
aguucuugaaggcauaucuua

SEQ ID NO: 31832 - RNA, 21 nt, Artificial Sequence
  Marburg virus siRNA sense strand
guucuugaaggcauaucuuaa

SEQ ID NO: 31833 - RNA, 21 nt, Artificial Sequence
  Marburg virus siRNA sense strand
uucuugaaggcauaucuuaau

SEQ ID NO: 31834 - RNA, 21 nt, Artificial Sequence
  Marburg virus siRNA sense strand
ucuugaaggcauaucuuaaua

SEQ ID NO: 31835 - RNA, 21 nt, Artificial Sequence
  Marburg virus siRNA sense strand
cuugaaggcauaucuuaauaa

SEQ ID NO: 31836 - RNA, 21 nt, Artificial Sequence
  Marburg virus siRNA sense strand
uugaaggcauaucuuaauaag

SEQ ID NO: 31837 - RNA, 21 nt, Artificial Sequence
  Marburg virus siRNA sense strand
ugaaggcauaucuuaauaaga

SEQ ID NO: 31838 - RNA, 21 nt, Artificial Sequence
  Marburg virus siRNA sense strand
gaaggcauaucuuaauaagau

SEQ ID NO: 31839 - RNA, 21 nt, Artificial Sequence
  Marburg virus siRNA sense strand
aaggcauaucuuaauaagauc

SEQ ID NO: 31840 - RNA, 21 nt, Artificial Sequence
  Marburg virus siRNA sense strand
aggcauaucuuaauaagaucu

SEQ ID NO: 31841 - RNA, 21 nt, Artificial Sequence
  Marburg virus siRNA sense strand
ggcauaucuuaauaagaucuu

SEQ ID NO: 31842 - RNA, 21 nt, Artificial Sequence
  Marburg virus siRNA sense strand
gcauaucuuaauaagaucuua

SEQ ID NO: 31843 - RNA, 21 nt, Artificial Sequence
  Marburg virus siRNA sense strand
cauaucuuaauaagaucuuag

SEQ ID NO: 31844 - RNA, 21 nt, Artificial Sequence
  Marburg virus siRNA sense strand
auaucuuaauaagaucuuagg

SEQ ID NO: 31845 - RNA, 21 nt, Artificial Sequence
  Marburg virus siRNA sense strand
uaucuuaauaagaucuuagga

SEQ ID NO: 31846 - RNA, 21 nt, Artificial Sequence
  Marburg virus siRNA sense strand
aucuuaauaagaucuuaggac

SEQ ID NO: 31847 - RNA, 21 nt, Artificial Sequence
  Marburg virus siRNA sense strand
ucuuaauaagaucuuaggacu

SEQ ID NO: 31848 - RNA, 21 nt, Artificial Sequence
  Marburg virus siRNA sense strand
cuuaauaagaucuuaggacuu

SEQ ID NO: 31849 - RNA, 21 nt, Artificial Sequence
  Marburg virus siRNA sense strand
uuaauaagaucuuaggacuug

SEQ ID NO: 31850 - RNA, 21 nt, Artificial Sequence
  Marburg virus siRNA sense strand
uaauaagaucuuaggacuuga

SEQ ID NO: 31851 - RNA, 21 nt, Artificial Sequence
  Marburg virus siRNA sense strand
aauaagaucuuaggacuugac

SEQ ID NO: 31852 - RNA, 21 nt, Artificial Sequence
  Marburg virus siRNA sense strand
auaagaucuuaggacuugacc

SEQ ID NO: 31853 - RNA, 21 nt, Artificial Sequence
  Marburg virus siRNA sense strand
uaagaucuuaggacuugacca

SEQ ID NO: 31854 - RNA, 21 nt, Artificial Sequence
  Marburg virus siRNA sense strand
aagaucuuaggacuugaccau

SEQ ID NO: 31855 - RNA, 21 nt, Artificial Sequence
  Marburg virus siRNA sense strand
agaucuuaggacuugaccaug

SEQ ID NO: 31856 - RNA, 21 nt, Artificial Sequence
  Marburg virus siRNA sense strand
gaucuuaggacuugaccaugu

SEQ ID NO: 31857 - RNA, 21 nt, Artificial Sequence
  Marburg virus siRNA sense strand
aucuuaggacuugaccauguu

SEQ ID NO: 31858 - RNA, 21 nt, Artificial Sequence
  Marburg virus siRNA sense strand
ucuuaggacuugaccauguuu

SEQ ID NO: 31859 - RNA, 21 nt, Artificial Sequence
  Marburg virus siRNA sense strand
cuuaggacuugaccauguuuu

SEQ ID NO: 31860 - RNA, 21 nt, Artificial Sequence
  Marburg virus siRNA sense strand
uuaggacuugaccauguuuuu

SEQ ID NO: 31861 - RNA, 21 nt, Artificial Sequence
  Marburg virus siRNA sense strand
uaggacuugaccauguuuuuc

SEQ ID NO: 31862 - RNA, 21 nt, Artificial Sequence
  Marburg virus siRNA sense strand
aggacuugaccauguuuuucc

SEQ ID NO: 31863 - RNA, 21 nt, Artificial Sequence
  Marburg virus siRNA sense strand
ggacuugaccauguuuuucca

SEQ ID NO: 31864 - RNA, 21 nt, Artificial Sequence
  Marburg virus siRNA sense strand
gacuugaccauguuuuuccag

SEQ ID NO: 31865 - RNA, 21 nt, Artificial Sequence
  Marburg virus siRNA sense strand
acuugaccauguuuuuccagc

SEQ ID NO: 31866 - RNA, 21 nt, Artificial Sequence
  Marburg virus siRNA sense strand
cuugaccauguuuuuccagcu

SEQ ID NO: 31867 - RNA, 21 nt, Artificial Sequence
  Marburg virus siRNA sense strand
uugaccauguuuuuccagcuu

SEQ ID NO: 31868 - RNA, 21 nt, Artificial Sequence
  Marburg virus siRNA sense strand
ugaccauguuuuuccagcuuc

SEQ ID NO: 31869 - RNA, 21 nt, Artificial Sequence
  Marburg virus siRNA sense strand
gaccauguuuuuccagcuucu

SEQ ID NO: 31870 - RNA, 21 nt, Artificial Sequence
  Marburg virus siRNA sense strand
accauguuuuuccagcuucug

SEQ ID NO: 31871 - RNA, 21 nt, Artificial Sequence
  Marburg virus siRNA sense strand
ccauguuuuuccagcuucugc

SEQ ID NO: 31872 - RNA, 21 nt, Artificial Sequence
  Marburg virus siRNA sense strand
cauguuuuuccagcuucugca

SEQ ID NO: 31873 - RNA, 21 nt, Artificial Sequence
  Marburg virus siRNA sense strand
auguuuuuccagcuucugcaa

SEQ ID NO: 31874 - RNA, 21 nt, Artificial Sequence
  Marburg virus siRNA sense strand
uguuuuuccagcuucugcaag

SEQ ID NO: 31875 - RNA, 21 nt, Artificial Sequence
  Marburg virus siRNA sense strand
guuuuuccagcuucugcaagg

SEQ ID NO: 31876 - RNA, 21 nt, Artificial Sequence
  Marburg virus siRNA sense strand
uuuuuccagcuucugcaaggu

SEQ ID NO: 31877 - RNA, 21 nt, Artificial Sequence
  Marburg virus siRNA sense strand
uuuuccagcuucugcaagguc

SEQ ID NO: 31878 - RNA, 21 nt, Artificial Sequence
  Marburg virus siRNA sense strand
uuuccagcuucugcaagguca

SEQ ID NO: 31879 - RNA, 21 nt, Artificial Sequence
  Marburg virus siRNA sense strand
uuccagcuucugcaaggucac

SEQ ID NO: 31880 - RNA, 21 nt, Artificial Sequence
  Marburg virus siRNA sense strand
uccagcuucugcaaggucaca

SEQ ID NO: 31881 - RNA, 21 nt, Artificial Sequence
  Marburg virus siRNA sense strand
ccagcuucugcaaggucacaa

SEQ ID NO: 31882 - RNA, 21 nt, Artificial Sequence
  Marburg virus siRNA sense strand
cagcuucugcaaggucacaau

SEQ ID NO: 31883 - RNA, 21 nt, Artificial Sequence
  Marburg virus siRNA sense strand
agcuucugcaaggucacaaug

SEQ ID NO: 31884 - RNA, 21 nt, Artificial Sequence
  Marburg virus siRNA sense strand
gcuucugcaaggucacaaugg

SEQ ID NO: 31885 - RNA, 21 nt, Artificial Sequence
  Marburg virus siRNA sense strand
cuucugcaaggucacaauggg

SEQ ID NO: 31886 - RNA, 21 nt, Artificial Sequence
  Marburg virus siRNA sense strand
uucugcaaggucacaauggga

SEQ ID NO: 31887 - RNA, 21 nt, Artificial Sequence
  Marburg virus siRNA sense strand
ucugcaaggucacaaugggag

SEQ ID NO: 31888 - RNA, 21 nt, Artificial Sequence
  Marburg virus siRNA sense strand
cugcaaggucacaaugggagg

SEQ ID NO: 31889 - RNA, 21 nt, Artificial Sequence
  Marburg virus siRNA sense strand
ugcaaggucacaaugggagga

SEQ ID NO: 31890 - RNA, 21 nt, Artificial Sequence
  Marburg virus siRNA sense strand
gcaaggucacaaugggaggau

SEQ ID NO: 31891 - RNA, 21 nt, Artificial Sequence
  Marburg virus siRNA sense strand
caaggucacaaugggaggauu

SEQ ID NO: 31892 - RNA, 21 nt, Artificial Sequence
  Marburg virus siRNA sense strand
aaggucacaaugggaggauuu

SEQ ID NO: 31893 - RNA, 21 nt, Artificial Sequence
  Marburg virus siRNA sense strand
aggucacaaugggaggauuuu

SEQ ID NO: 31894 - RNA, 21 nt, Artificial Sequence
  Marburg virus siRNA sense strand
ggucacaaugggaggauuuuu

SEQ ID NO: 31895 - RNA, 21 nt, Artificial Sequence
  Marburg virus siRNA sense strand
gucacaaugggaggauuuuuc

SEQ ID NO: 31896 - RNA, 21 nt, Artificial Sequence
  Marburg virus siRNA sense strand
ucacaaugggaggauuuuucu

SEQ ID NO: 31897 - RNA, 21 nt, Artificial Sequence
  Marburg virus siRNA sense strand
cacaaugggaggauuuuucuc

SEQ ID NO: 31898 - RNA, 21 nt, Artificial Sequence
  Marburg virus siRNA sense strand
acaaugggaggauuuuucucc

SEQ ID NO: 31899 - RNA, 21 nt, Artificial Sequence
  Marburg virus siRNA sense strand
caaugggaggauuuuucuccu

SEQ ID NO: 31900 - RNA, 21 nt, Artificial Sequence
  Marburg virus siRNA sense strand
aaugggaggauuuuucuccua

SEQ ID NO: 31901 - RNA, 21 nt, Artificial Sequence
  Marburg virus siRNA sense strand
augggaggauuuuucuccuaa

SEQ ID NO: 31902 - RNA, 21 nt, Artificial Sequence
  Marburg virus siRNA sense strand
ugggaggauuuuucuccuaag

SEQ ID NO: 31903 - RNA, 21 nt, Artificial Sequence
  Marburg virus siRNA sense strand
gggaggauuuuucuccuaagg

SEQ ID NO: 31904 - RNA, 21 nt, Artificial Sequence
  Marburg virus siRNA sense strand
ggaggauuuuucuccuaagga

SEQ ID NO: 31905 - RNA, 21 nt, Artificial Sequence
  Marburg virus siRNA sense strand
gaggauuuuucuccuaaggaa

SEQ ID NO: 31906 - RNA, 21 nt, Artificial Sequence
  Marburg virus siRNA sense strand
aggauuuuucuccuaaggaaa

SEQ ID NO: 31907 - RNA, 21 nt, Artificial Sequence
  Marburg virus siRNA sense strand
ggauuuuucuccuaaggaaaa

SEQ ID NO: 31908 - RNA, 21 nt, Artificial Sequence
  Marburg virus siRNA sense strand
gauuuuucuccuaaggaaaau

SEQ ID NO: 31909 - RNA, 21 nt, Artificial Sequence
  Marburg virus siRNA sense strand
auuuuucuccuaaggaaaauc

SEQ ID NO: 31910 - RNA, 21 nt, Artificial Sequence
  Marburg virus siRNA sense strand
uuuuucuccuaaggaaaaucc

SEQ ID NO: 31911 - RNA, 21 nt, Artificial Sequence
  Marburg virus siRNA sense strand
uuuucuccuaaggaaaauccu

SEQ ID NO: 31912 - RNA, 21 nt, Artificial Sequence
  Marburg virus siRNA sense strand
uuucuccuaaggaaaauccuu

SEQ ID NO: 31913 - RNA, 21 nt, Artificial Sequence
  Marburg virus siRNA sense strand
uucuccuaaggaaaauccuua

SEQ ID NO: 31914 - RNA, 21 nt, Artificial Sequence
  Marburg virus siRNA sense strand
ucuccuaaggaaaauccuuau

SEQ ID NO: 31915 - RNA, 21 nt, Artificial Sequence
  Marburg virus siRNA sense strand
cuccuaaggaaaauccuuauu

SEQ ID NO: 31916 - RNA, 21 nt, Artificial Sequence
  Marburg virus siRNA sense strand
uccuaaggaaaauccuuauua

SEQ ID NO: 31917 - RNA, 21 nt, Artificial Sequence
  Marburg virus siRNA sense strand
ccuaaggaaaauccuuauuau

SEQ ID NO: 31918 - RNA, 21 nt, Artificial Sequence
  Marburg virus siRNA sense strand
cuaaggaaaauccuuauuauu

SEQ ID NO: 31919 - RNA, 21 nt, Artificial Sequence
  Marburg virus siRNA sense strand
uaaggaaaauccuuauuauug

SEQ ID NO: 31920 - RNA, 21 nt, Artificial Sequence
  Marburg virus siRNA sense strand
aaggaaaauccuuauuauugg

SEQ ID NO: 31921 - RNA, 21 nt, Artificial Sequence
  Marburg virus siRNA sense strand
aggaaaauccuuauuauuggg

SEQ ID NO: 31922 - RNA, 21 nt, Artificial Sequence
  Marburg virus siRNA sense strand
ggaaaauccuuauuauugggg

SEQ ID NO: 31923 - RNA, 21 nt, Artificial Sequence
  Marburg virus siRNA sense strand
gaaaauccuuauuauuggggg

SEQ ID NO: 31924 - RNA, 21 nt, Artificial Sequence
  Marburg virus siRNA sense strand
aaaauccuuauuauuggggga

SEQ ID NO: 31925 - RNA, 21 nt, Artificial Sequence
  Marburg virus siRNA sense strand
aaauccuuauuauugggggau

SEQ ID NO: 31926 - RNA, 21 nt, Artificial Sequence
  Marburg virus siRNA sense strand
aauccuuauuauugggggaug

SEQ ID NO: 31927 - RNA, 21 nt, Artificial Sequence
  Marburg virus siRNA sense strand
auccuuauuauugggggaugc

SEQ ID NO: 31928 - RNA, 21 nt, Artificial Sequence
  Marburg virus siRNA sense strand
uccuuauuauugggggaugcu

SEQ ID NO: 31929 - RNA, 21 nt, Artificial Sequence
  Marburg virus siRNA sense strand
ccuuauuauugggggaugcug

SEQ ID NO: 31930 - RNA, 21 nt, Artificial Sequence
  Marburg virus siRNA sense strand
cuuauuauugggggaugcugu

SEQ ID NO: 31931 - RNA, 21 nt, Artificial Sequence
  Marburg virus siRNA sense strand
uuauuauugggggaugcuguu

SEQ ID NO: 31932 - RNA, 21 nt, Artificial Sequence
  Marburg virus siRNA sense strand
uauuauugggggaugcuguua

SEQ ID NO: 31933 - RNA, 21 nt, Artificial Sequence
  Marburg virus siRNA sense strand
auuauugggggaugcuguuac

SEQ ID NO: 31934 - RNA, 21 nt, Artificial Sequence
  Marburg virus siRNA sense strand
uuauugggggaugcuguuacu

SEQ ID NO: 31935 - RNA, 21 nt, Artificial Sequence
  Marburg virus siRNA sense strand
uauugggggaugcuguuacuc

SEQ ID NO: 31936 - RNA, 21 nt, Artificial Sequence
  Marburg virus siRNA sense strand
auugggggaugcuguuacucg

SEQ ID NO: 31937 - RNA, 21 nt, Artificial Sequence
  Marburg virus siRNA sense strand
uugggggaugcuguuacucgu

SEQ ID NO: 31938 - RNA, 21 nt, Artificial Sequence
  Marburg virus siRNA sense strand
ugggggaugcuguuacucgug

SEQ ID NO: 31939 - RNA, 21 nt, Artificial Sequence
  Marburg virus siRNA sense strand
gggggaugcuguuacucgugc

SEQ ID NO: 31940 - RNA, 21 nt, Artificial Sequence
  Marburg virus siRNA sense strand
ggggaugcuguuacucgugca

SEQ ID NO: 31941 - RNA, 21 nt, Artificial Sequence
  Marburg virus siRNA sense strand
gggaugcuguuacucgugcau

SEQ ID NO: 31942 - RNA, 21 nt, Artificial Sequence
  Marburg virus siRNA sense strand
ggaugcuguuacucgugcauu

SEQ ID NO: 31943 - RNA, 21 nt, Artificial Sequence
  Marburg virus siRNA sense strand
gaugcuguuacucgugcauuu

SEQ ID NO: 31944 - RNA, 21 nt, Artificial Sequence
  Marburg virus siRNA sense strand
augcuguuacucgugcauuua

SEQ ID NO: 31945 - RNA, 21 nt, Artificial Sequence
  Marburg virus siRNA sense strand
ugcuguuacucgugcauuuau

SEQ ID NO: 31946 - RNA, 21 nt, Artificial Sequence
  Marburg virus siRNA sense strand
gcuguuacucgugcauuuauc

SEQ ID NO: 31947 - RNA, 21 nt, Artificial Sequence
  Marburg virus siRNA sense strand
cuguuacucgugcauuuaucu

SEQ ID NO: 31948 - RNA, 21 nt, Artificial Sequence
  Marburg virus siRNA sense strand
uguuacucgugcauuuaucuc

SEQ ID NO: 31949 - RNA, 21 nt, Artificial Sequence
  Marburg virus siRNA sense strand
guuacucgugcauuuaucuca

SEQ ID NO: 31950 - RNA, 21 nt, Artificial Sequence
  Marburg virus siRNA sense strand
uuacucgugcauuuaucucaa

SEQ ID NO: 31951 - RNA, 21 nt, Artificial Sequence
  Marburg virus siRNA sense strand
uacucgugcauuuaucucaac

SEQ ID NO: 31952 - RNA, 21 nt, Artificial Sequence
  Marburg virus siRNA sense strand
acucgugcauuuaucucaacu

SEQ ID NO: 31953 - RNA, 21 nt, Artificial Sequence
  Marburg virus siRNA sense strand
cucgugcauuuaucucaacuu

SEQ ID NO: 31954 - RNA, 21 nt, Artificial Sequence
  Marburg virus siRNA sense strand
ucgugcauuuaucucaacuug

SEQ ID NO: 31955 - RNA, 21 nt, Artificial Sequence
  Marburg virus siRNA sense strand
cgugcauuuaucucaacuugc

SEQ ID NO: 31956 - RNA, 21 nt, Artificial Sequence
  Marburg virus siRNA sense strand
gugcauuuaucucaacuugcc

SEQ ID NO: 31957 - RNA, 21 nt, Artificial Sequence
  Marburg virus siRNA sense strand
ugcauuuaucucaacuugcca

SEQ ID NO: 31958 - RNA, 21 nt, Artificial Sequence
  Marburg virus siRNA sense strand
gcauuuaucucaacuugccag

SEQ ID NO: 31959 - RNA, 21 nt, Artificial Sequence
  Marburg virus siRNA sense strand
cauuuaucucaacuugccagg

SEQ ID NO: 31960 - RNA, 21 nt, Artificial Sequence
  Marburg virus siRNA sense strand
auuuaucucaacuugccagga

SEQ ID NO: 31961 - RNA, 21 nt, Artificial Sequence
  Marburg virus siRNA sense strand
uuuaucucaacuugccaggag

SEQ ID NO: 31962 - RNA, 21 nt, Artificial Sequence
  Marburg virus siRNA sense strand
uuaucucaacuugccaggagg

SEQ ID NO: 31963 - RNA, 21 nt, Artificial Sequence
  Marburg virus siRNA sense strand
uaucucaacuugccaggagga

SEQ ID NO: 31964 - RNA, 21 nt, Artificial Sequence
  Marburg virus siRNA sense strand
aucucaacuugccaggaggau

SEQ ID NO: 31965 - RNA, 21 nt, Artificial Sequence
  Marburg virus siRNA sense strand
ucucaacuugccaggaggaua

SEQ ID NO: 31966 - RNA, 21 nt, Artificial Sequence
  Marburg virus siRNA sense strand
cucaacuugccaggaggauaa

SEQ ID NO: 31967 - RNA, 21 nt, Artificial Sequence
  Marburg virus siRNA sense strand
ucaacuugccaggaggauaaa

SEQ ID NO: 31968 - RNA, 21 nt, Artificial Sequence
  Marburg virus siRNA sense strand
caacuugccaggaggauaaaa

SEQ ID NO: 31969 - RNA, 21 nt, Artificial Sequence
  Marburg virus siRNA sense strand
aacuugccaggaggauaaaag

SEQ ID NO: 31970 - RNA, 21 nt, Artificial Sequence
  Marburg virus siRNA sense strand
acuugccaggaggauaaaagg

SEQ ID NO: 31971 - RNA, 21 nt, Artificial Sequence
  Marburg virus siRNA sense strand
cuugccaggaggauaaaagga

SEQ ID NO: 31972 - RNA, 21 nt, Artificial Sequence
  Marburg virus siRNA sense strand
uugccaggaggauaaaaggac

SEQ ID NO: 31973 - RNA, 21 nt, Artificial Sequence
  Marburg virus siRNA sense strand
ugccaggaggauaaaaggaca

SEQ ID NO: 31974 - RNA, 21 nt, Artificial Sequence
  Marburg virus siRNA sense strand
gccaggaggauaaaaggacaa

SEQ ID NO: 31975 - RNA, 21 nt, Artificial Sequence
  Marburg virus siRNA sense strand
ccaggaggauaaaaggacaaa

SEQ ID NO: 31976 - RNA, 21 nt, Artificial Sequence
  Marburg virus siRNA sense strand
caggaggauaaaaggacaaag

SEQ ID NO: 31977 - RNA, 21 nt, Artificial Sequence
  Marburg virus siRNA sense strand
aggaggauaaaaggacaaaga

SEQ ID NO: 31978 - RNA, 21 nt, Artificial Sequence
  Marburg virus siRNA sense strand
ggaggauaaaaggacaaagag

SEQ ID NO: 31979 - RNA, 21 nt, Artificial Sequence
  Marburg virus siRNA sense strand
gaggauaaaaggacaaagagg

SEQ ID NO: 31980 - RNA, 21 nt, Artificial Sequence
  Marburg virus siRNA sense strand
aggauaaaaggacaaagaggg

SEQ ID NO: 31981 - RNA, 21 nt, Artificial Sequence
  Marburg virus siRNA sense strand
ggauaaaaggacaaagagggu

SEQ ID NO: 31982 - RNA, 21 nt, Artificial Sequence
  Marburg virus siRNA sense strand
gauaaaaggacaaagaggguc

SEQ ID NO: 31983 - RNA, 21 nt, Artificial Sequence
  Marburg virus siRNA sense strand
auaaaaggacaaagaggguca

SEQ ID NO: 31984 - RNA, 21 nt, Artificial Sequence
  Marburg virus siRNA sense strand
uaaaaggacaaagagggucau

SEQ ID NO: 31985 - RNA, 21 nt, Artificial Sequence
  Marburg virus siRNA sense strand
aaaaggacaaagagggucauu

SEQ ID NO: 31986 - RNA, 21 nt, Artificial Sequence
  Marburg virus siRNA sense strand
aaaggacaaagagggucauua

SEQ ID NO: 31987 - RNA, 21 nt, Artificial Sequence
  Marburg virus siRNA sense strand
aaggacaaagagggucauuaa

SEQ ID NO: 31988 - RNA, 21 nt, Artificial Sequence
  Marburg virus siRNA sense strand
aggacaaagagggucauuaag

SEQ ID NO: 31989 - RNA, 21 nt, Artificial Sequence
  Marburg virus siRNA sense strand
ggacaaagagggucauuaaga

SEQ ID NO: 31990 - RNA, 21 nt, Artificial Sequence
  Marburg virus siRNA sense strand
gacaaagagggucauuaagaa

SEQ ID NO: 31991 - RNA, 21 nt, Artificial Sequence
  Marburg virus siRNA sense strand
acaaagagggucauuaagaag

SEQ ID NO: 31992 - RNA, 21 nt, Artificial Sequence
  Marburg virus siRNA sense strand
caaagagggucauuaagaagu

SEQ ID NO: 31993 - RNA, 21 nt, Artificial Sequence
  Marburg virus siRNA sense strand
aaagagggucauuaagaagua

SEQ ID NO: 31994 - RNA, 21 nt, Artificial Sequence
  Marburg virus siRNA sense strand
aagagggucauuaagaaguaa

SEQ ID NO: 31995 - RNA, 21 nt, Artificial Sequence
  Marburg virus siRNA sense strand
agagggucauuaagaaguaac

SEQ ID NO: 31996 - RNA, 21 nt, Artificial Sequence
  Marburg virus siRNA sense strand
gagggucauuaagaaguaacu

SEQ ID NO: 31997 - RNA, 21 nt, Artificial Sequence
  Marburg virus siRNA sense strand
agggucauuaagaaguaacug

SEQ ID NO: 31998 - RNA, 21 nt, Artificial Sequence
  Marburg virus siRNA sense strand
gggucauuaagaaguaacugg

SEQ ID NO: 31999 - RNA, 21 nt, Artificial Sequence
  Marburg virus siRNA sense strand
ggucauuaagaaguaacugga

SEQ ID NO: 32000 - RNA, 21 nt, Artificial Sequence
  Marburg virus siRNA sense strand
gucauuaagaaguaacuggaa

SEQ ID NO: 32001 - RNA, 21 nt, Artificial Sequence
  Marburg virus siRNA sense strand
ucauuaagaaguaacuggaag

SEQ ID NO: 32002 - RNA, 21 nt, Artificial Sequence
  Marburg virus siRNA sense strand
cauuaagaaguaacuggaagu

SEQ ID NO: 32003 - RNA, 21 nt, Artificial Sequence
  Marburg virus siRNA sense strand
auuaagaaguaacuggaaguu

SEQ ID NO: 32004 - RNA, 21 nt, Artificial Sequence
  Marburg virus siRNA sense strand
uuaagaaguaacuggaaguuu

SEQ ID NO: 32005 - RNA, 21 nt, Artificial Sequence
  Marburg virus siRNA sense strand
uaagaaguaacuggaaguuua

SEQ ID NO: 32006 - RNA, 21 nt, Artificial Sequence
  Marburg virus siRNA sense strand
aagaaguaacuggaaguuuau

SEQ ID NO: 32007 - RNA, 21 nt, Artificial Sequence
  Marburg virus siRNA sense strand
agaaguaacuggaaguuuaua

SEQ ID NO: 32008 - RNA, 21 nt, Artificial Sequence
  Marburg virus siRNA sense strand
gaaguaacuggaaguuuauag

SEQ ID NO: 32009 - RNA, 21 nt, Artificial Sequence
  Marburg virus siRNA sense strand
aaguaacuggaaguuuauagg

SEQ ID NO: 32010 - RNA, 21 nt, Artificial Sequence
  Marburg virus siRNA sense strand
aguaacuggaaguuuauagga

SEQ ID NO: 32011 - RNA, 21 nt, Artificial Sequence
  Marburg virus siRNA sense strand
guaacuggaaguuuauaggaa

SEQ ID NO: 32012 - RNA, 21 nt, Artificial Sequence
  Marburg virus siRNA sense strand
uaacuggaaguuuauaggaac

SEQ ID NO: 32013 - RNA, 21 nt, Artificial Sequence
  Marburg virus siRNA sense strand
aacuggaaguuuauaggaaca

SEQ ID NO: 32014 - RNA, 21 nt, Artificial Sequence
  Marburg virus siRNA sense strand
acuggaaguuuauaggaacag

SEQ ID NO: 32015 - RNA, 21 nt, Artificial Sequence
  Marburg virus siRNA sense strand
cuggaaguuuauaggaacaga

SEQ ID NO: 32016 - RNA, 21 nt, Artificial Sequence
  Marburg virus siRNA sense strand
uggaaguuuauaggaacagau

SEQ ID NO: 32017 - RNA, 21 nt, Artificial Sequence
  Marburg virus siRNA sense strand
ggaaguuuauaggaacagauu

SEQ ID NO: 32018 - RNA, 21 nt, Artificial Sequence
  Marburg virus siRNA sense strand
gaaguuuauaggaacagauuu

SEQ ID NO: 32019 - RNA, 21 nt, Artificial Sequence
  Marburg virus siRNA sense strand
aaguuuauaggaacagauuua

SEQ ID NO: 32020 - RNA, 21 nt, Artificial Sequence
  Marburg virus siRNA sense strand
aguuuauaggaacagauuuag

SEQ ID NO: 32021 - RNA, 21 nt, Artificial Sequence
  Marburg virus siRNA sense strand
guuuauaggaacagauuuaga

SEQ ID NO: 32022 - RNA, 21 nt, Artificial Sequence
  Marburg virus siRNA sense strand
uuuauaggaacagauuuagag

SEQ ID NO: 32023 - RNA, 21 nt, Artificial Sequence
  Marburg virus siRNA sense strand
uuauaggaacagauuuagagc

SEQ ID NO: 32024 - RNA, 21 nt, Artificial Sequence
  Marburg virus siRNA sense strand
uauaggaacagauuuagagcu

SEQ ID NO: 32025 - RNA, 21 nt, Artificial Sequence
  Marburg virus siRNA sense strand
auaggaacagauuuagagcug

SEQ ID NO: 32026 - RNA, 21 nt, Artificial Sequence
  Marburg virus siRNA sense strand
uaggaacagauuuagagcugu

SEQ ID NO: 32027 - RNA, 21 nt, Artificial Sequence
  Marburg virus siRNA sense strand
aggaacagauuuagagcuguu

SEQ ID NO: 32028 - RNA, 21 nt, Artificial Sequence
  Marburg virus siRNA sense strand
ggaacagauuuagagcuguuu

SEQ ID NO: 32029 - RNA, 21 nt, Artificial Sequence
  Marburg virus siRNA sense strand
gaacagauuuagagcuguuug

SEQ ID NO: 32030 - RNA, 21 nt, Artificial Sequence
  Marburg virus siRNA sense strand
aacagauuuagagcuguuugg

SEQ ID NO: 32031 - RNA, 21 nt, Artificial Sequence
  Marburg virus siRNA sense strand
acagauuuagagcuguuugga

SEQ ID NO: 32032 - RNA, 21 nt, Artificial Sequence
  Marburg virus siRNA sense strand
cagauuuagagcuguuuggaa

SEQ ID NO: 32033 - RNA, 21 nt, Artificial Sequence
  Marburg virus siRNA sense strand
agauuuagagcuguuuggaau

SEQ ID NO: 32034 - RNA, 21 nt, Artificial Sequence
  Marburg virus siRNA sense strand
gauuuagagcuguuuggaaua

SEQ ID NO: 32035 - RNA, 21 nt, Artificial Sequence
  Marburg virus siRNA sense strand
auuuagagcuguuuggaauag

SEQ ID NO: 32036 - RNA, 21 nt, Artificial Sequence
  Marburg virus siRNA sense strand
uuuagagcuguuuggaauagc

SEQ ID NO: 32037 - RNA, 21 nt, Artificial Sequence
  Marburg virus siRNA sense strand
uuagagcuguuuggaauagca

SEQ ID NO: 32038 - RNA, 21 nt, Artificial Sequence
  Marburg virus siRNA sense strand
uagagcuguuuggaauagcag

SEQ ID NO: 32039 - RNA, 21 nt, Artificial Sequence
  Marburg virus siRNA sense strand
agagcuguuuggaauagcaga

SEQ ID NO: 32040 - RNA, 21 nt, Artificial Sequence
  Marburg virus siRNA sense strand
gagcuguuuggaauagcagau

SEQ ID NO: 32041 - RNA, 21 nt, Artificial Sequence
  Marburg virus siRNA sense strand
agcuguuuggaauagcagauu

SEQ ID NO: 32042 - RNA, 21 nt, Artificial Sequence
  Marburg virus siRNA sense strand
gcuguuuggaauagcagauuu

SEQ ID NO: 32043 - RNA, 21 nt, Artificial Sequence
  Marburg virus siRNA sense strand
cuguuuggaauagcagauuuu

SEQ ID NO: 32044 - RNA, 21 nt, Artificial Sequence
  Marburg virus siRNA sense strand
uguuuggaauagcagauuuua

SEQ ID NO: 32045 - RNA, 21 nt, Artificial Sequence
  Marburg virus siRNA sense strand
guuuggaauagcagauuuuau

SEQ ID NO: 32046 - RNA, 21 nt, Artificial Sequence
  Marburg virus siRNA sense strand
uuuggaauagcagauuuuauu

SEQ ID NO: 32047 - RNA, 21 nt, Artificial Sequence
  Marburg virus siRNA sense strand
uuggaauagcagauuuuauua

SEQ ID NO: 32048 - RNA, 21 nt, Artificial Sequence
  Marburg virus siRNA sense strand
uggaauagcagauuuuauuau

SEQ ID NO: 32049 - RNA, 21 nt, Artificial Sequence
  Marburg virus siRNA sense strand
ggaauagcagauuuuauuauu

SEQ ID NO: 32050 - RNA, 21 nt, Artificial Sequence
  Marburg virus siRNA sense strand
gaauagcagauuuuauuauuu

SEQ ID NO: 32051 - RNA, 21 nt, Artificial Sequence
  Marburg virus siRNA sense strand
aauagcagauuuuauuauuuu

SEQ ID NO: 32052 - RNA, 21 nt, Artificial Sequence
  Marburg virus siRNA sense strand
auagcagauuuuauuauuuuu

SEQ ID NO: 32053 - RNA, 21 nt, Artificial Sequence
  Marburg virus siRNA sense strand
uagcagauuuuauuauuuuua

SEQ ID NO: 32054 - RNA, 21 nt, Artificial Sequence
  Marburg virus siRNA sense strand
agcagauuuuauuauuuuuaa

SEQ ID NO: 32055 - RNA, 21 nt, Artificial Sequence
  Marburg virus siRNA sense strand
gcagauuuuauuauuuuuaaa

SEQ ID NO: 32056 - RNA, 21 nt, Artificial Sequence
  Marburg virus siRNA sense strand
cagauuuuauuauuuuuaaag

SEQ ID NO: 32057 - RNA, 21 nt, Artificial Sequence
  Marburg virus siRNA sense strand
agauuuuauuauuuuuaaagu

SEQ ID NO: 32058 - RNA, 21 nt, Artificial Sequence
  Marburg virus siRNA sense strand
gauuuuauuauuuuuaaaguu

SEQ ID NO: 32059 - RNA, 21 nt, Artificial Sequence
  Marburg virus siRNA sense strand
auuuuauuauuuuuaaaguuc

SEQ ID NO: 32060 - RNA, 21 nt, Artificial Sequence
  Marburg virus siRNA sense strand
uuuuauuauuuuuaaaguucc

SEQ ID NO: 32061 - RNA, 21 nt, Artificial Sequence
  Marburg virus siRNA sense strand
uuuauuauuuuuaaaguucca

SEQ ID NO: 32062 - RNA, 21 nt, Artificial Sequence
  Marburg virus siRNA sense strand
uuauuauuuuuaaaguuccag

SEQ ID NO: 32063 - RNA, 21 nt, Artificial Sequence
  Marburg virus siRNA sense strand
uauuauuuuuaaaguuccagu

SEQ ID NO: 32064 - RNA, 21 nt, Artificial Sequence
  Marburg virus siRNA sense strand
auuauuuuuaaaguuccagua

SEQ ID NO: 32065 - RNA, 21 nt, Artificial Sequence
  Marburg virus siRNA sense strand
uuauuuuuaaaguuccaguaa

SEQ ID NO: 32066 - RNA, 21 nt, Artificial Sequence
  Marburg virus siRNA sense strand
uauuuuuaaaguuccaguaaa

SEQ ID NO: 32067 - RNA, 21 nt, Artificial Sequence
  Marburg virus siRNA sense strand
auuuuuaaaguuccaguaaaa

SEQ ID NO: 32068 - RNA, 21 nt, Artificial Sequence
  Marburg virus siRNA sense strand
uuuuuaaaguuccaguaaaaa

SEQ ID NO: 32069 - RNA, 21 nt, Artificial Sequence
  Marburg virus siRNA sense strand
uuuuaaaguuccaguaaaaac

SEQ ID NO: 32070 - RNA, 21 nt, Artificial Sequence
  Marburg virus siRNA sense strand
uuuaaaguuccaguaaaaaca

SEQ ID NO: 32071 - RNA, 21 nt, Artificial Sequence
  Marburg virus siRNA sense strand
uuaaaguuccaguaaaaacaa

SEQ ID NO: 32072 - RNA, 21 nt, Artificial Sequence
  Marburg virus siRNA sense strand
uaaaguuccaguaaaaacaau

SEQ ID NO: 32073 - RNA, 21 nt, Artificial Sequence
  Marburg virus siRNA sense strand
aaaguuccaguaaaaacaaua

SEQ ID NO: 32074 - RNA, 21 nt, Artificial Sequence
  Marburg virus siRNA sense strand
aaguuccaguaaaaacaauaa

SEQ ID NO: 32075 - RNA, 21 nt, Artificial Sequence
  Marburg virus siRNA sense strand
aguuccaguaaaaacaauaau

SEQ ID NO: 32076 - RNA, 21 nt, Artificial Sequence
  Marburg virus siRNA sense strand
guuccaguaaaaacaauaauc

SEQ ID NO: 32077 - RNA, 21 nt, Artificial Sequence
  Marburg virus siRNA sense strand
uuccaguaaaaacaauaaucc

SEQ ID NO: 32078 - RNA, 21 nt, Artificial Sequence
  Marburg virus siRNA sense strand
uccaguaaaaacaauaauccg

SEQ ID NO: 32079 - RNA, 21 nt, Artificial Sequence
  Marburg virus siRNA sense strand
ccaguaaaaacaauaauccga

SEQ ID NO: 32080 - RNA, 21 nt, Artificial Sequence
  Marburg virus siRNA sense strand
caguaaaaacaauaauccgaa

SEQ ID NO: 32081 - RNA, 21 nt, Artificial Sequence
  Marburg virus siRNA sense strand
aguaaaaacaauaauccgaaa

SEQ ID NO: 32082 - RNA, 21 nt, Artificial Sequence
  Marburg virus siRNA sense strand
guaaaaacaauaauccgaaau

SEQ ID NO: 32083 - RNA, 21 nt, Artificial Sequence
  Marburg virus siRNA sense strand
uaaaaacaauaauccgaaaug

SEQ ID NO: 32084 - RNA, 21 nt, Artificial Sequence
  Marburg virus siRNA sense strand
aaaaacaauaauccgaaaugc

SEQ ID NO: 32085 - RNA, 21 nt, Artificial Sequence
  Marburg virus siRNA sense strand
aaaacaauaauccgaaaugcu

SEQ ID NO: 32086 - RNA, 21 nt, Artificial Sequence
  Marburg virus siRNA sense strand
aaacaauaauccgaaaugcug

SEQ ID NO: 32087 - RNA, 21 nt, Artificial Sequence
  Marburg virus siRNA sense strand
aacaauaauccgaaaugcugu

SEQ ID NO: 32088 - RNA, 21 nt, Artificial Sequence
  Marburg virus siRNA sense strand
acaauaauccgaaaugcugua

SEQ ID NO: 32089 - RNA, 21 nt, Artificial Sequence
  Marburg virus siRNA sense strand
caauaauccgaaaugcuguaa

SEQ ID NO: 32090 - RNA, 21 nt, Artificial Sequence
  Marburg virus siRNA sense strand
aauaauccgaaaugcuguaag

SEQ ID NO: 32091 - RNA, 21 nt, Artificial Sequence
  Marburg virus siRNA sense strand
auaauccgaaaugcuguaagc

SEQ ID NO: 32092 - RNA, 21 nt, Artificial Sequence
  Marburg virus siRNA sense strand
uaauccgaaaugcuguaagcu

SEQ ID NO: 32093 - RNA, 21 nt, Artificial Sequence
  Marburg virus siRNA sense strand
aauccgaaaugcuguaagcuu

SEQ ID NO: 32094 - RNA, 21 nt, Artificial Sequence
  Marburg virus siRNA sense strand
auccgaaaugcuguaagcuua

SEQ ID NO: 32095 - RNA, 21 nt, Artificial Sequence
  Marburg virus siRNA sense strand
uccgaaaugcuguaagcuuac

SEQ ID NO: 32096 - RNA, 21 nt, Artificial Sequence
  Marburg virus siRNA sense strand
ccgaaaugcuguaagcuuaca

SEQ ID NO: 32097 - RNA, 21 nt, Artificial Sequence
  Marburg virus siRNA sense strand
cgaaaugcuguaagcuuacaa

SEQ ID NO: 32098 - RNA, 21 nt, Artificial Sequence
  Marburg virus siRNA sense strand
gaaaugcuguaagcuuacaag

SEQ ID NO: 32099 - RNA, 21 nt, Artificial Sequence
  Marburg virus siRNA sense strand
aaaugcuguaagcuuacaagc

SEQ ID NO: 32100 - RNA, 21 nt, Artificial Sequence
  Marburg virus siRNA sense strand
aaugcuguaagcuuacaagcu

SEQ ID NO: 32101 - RNA, 21 nt, Artificial Sequence
  Marburg virus siRNA sense strand
augcuguaagcuuacaagcuu

SEQ ID NO: 32102 - RNA, 21 nt, Artificial Sequence
  Marburg virus siRNA sense strand
ugcuguaagcuuacaagcuuc

SEQ ID NO: 32103 - RNA, 21 nt, Artificial Sequence
  Marburg virus siRNA sense strand
gcuguaagcuuacaagcuuca

SEQ ID NO: 32104 - RNA, 21 nt, Artificial Sequence
  Marburg virus siRNA sense strand
cuguaagcuuacaagcuucaa

SEQ ID NO: 32105 - RNA, 21 nt, Artificial Sequence
  Marburg virus siRNA sense strand
uguaagcuuacaagcuucaaa

SEQ ID NO: 32106 - RNA, 21 nt, Artificial Sequence
  Marburg virus siRNA sense strand
guaagcuuacaagcuucaaaa

SEQ ID NO: 32107 - RNA, 21 nt, Artificial Sequence
  Marburg virus siRNA sense strand
uaagcuuacaagcuucaaaac

SEQ ID NO: 32108 - RNA, 21 nt, Artificial Sequence
  Marburg virus siRNA sense strand
aagcuuacaagcuucaaaacc

SEQ ID NO: 32109 - RNA, 21 nt, Artificial Sequence
  Marburg virus siRNA sense strand
agcuuacaagcuucaaaacca

SEQ ID NO: 32110 - RNA, 21 nt, Artificial Sequence
  Marburg virus siRNA sense strand
gcuuacaagcuucaaaaccag

SEQ ID NO: 32111 - RNA, 21 nt, Artificial Sequence
  Marburg virus siRNA sense strand
cuuacaagcuucaaaaccagg

SEQ ID NO: 32112 - RNA, 21 nt, Artificial Sequence
  Marburg virus siRNA sense strand
uuacaagcuucaaaaccaggg

SEQ ID NO: 32113 - RNA, 21 nt, Artificial Sequence
  Marburg virus siRNA sense strand
uacaagcuucaaaaccagggu

SEQ ID NO: 32114 - RNA, 21 nt, Artificial Sequence
  Marburg virus siRNA sense strand
acaagcuucaaaaccaggguu

SEQ ID NO: 32115 - RNA, 21 nt, Artificial Sequence
  Marburg virus siRNA sense strand
caagcuucaaaaccaggguua

SEQ ID NO: 32116 - RNA, 21 nt, Artificial Sequence
  Marburg virus siRNA sense strand
aagcuucaaaaccaggguuaa

SEQ ID NO: 32117 - RNA, 21 nt, Artificial Sequence
  Marburg virus siRNA sense strand
agcuucaaaaccaggguuaag

SEQ ID NO: 32118 - RNA, 21 nt, Artificial Sequence
  Marburg virus siRNA sense strand
gcuucaaaaccaggguuaaga

SEQ ID NO: 32119 - RNA, 21 nt, Artificial Sequence
  Marburg virus siRNA sense strand
cuucaaaaccaggguuaagag

SEQ ID NO: 32120 - RNA, 21 nt, Artificial Sequence
  Marburg virus siRNA sense strand
uucaaaaccaggguuaagagu

SEQ ID NO: 32121 - RNA, 21 nt, Artificial Sequence
  Marburg virus siRNA sense strand
ucaaaaccaggguuaagagua

SEQ ID NO: 32122 - RNA, 21 nt, Artificial Sequence
  Marburg virus siRNA sense strand
caaaaccaggguuaagaguau

SEQ ID NO: 32123 - RNA, 21 nt, Artificial Sequence
  Marburg virus siRNA sense strand
aaaaccaggguuaagaguaug

SEQ ID NO: 32124 - RNA, 21 nt, Artificial Sequence
  Marburg virus siRNA sense strand
aaaccaggguuaagaguaugg

SEQ ID NO: 32125 - RNA, 21 nt, Artificial Sequence
  Marburg virus siRNA sense strand
aaccaggguuaagaguauggu

SEQ ID NO: 32126 - RNA, 21 nt, Artificial Sequence
  Marburg virus siRNA sense strand
accaggguuaagaguauggua

SEQ ID NO: 32127 - RNA, 21 nt, Artificial Sequence
  Marburg virus siRNA sense strand
ccaggguuaagaguaugguac

SEQ ID NO: 32128 - RNA, 21 nt, Artificial Sequence
  Marburg virus siRNA sense strand
caggguuaagaguaugguacc

SEQ ID NO: 32129 - RNA, 21 nt, Artificial Sequence
  Marburg virus siRNA sense strand
aggguuaagaguaugguaccg

SEQ ID NO: 32130 - RNA, 21 nt, Artificial Sequence
  Marburg virus siRNA sense strand
ggguuaagaguaugguaccgu

SEQ ID NO: 32131 - RNA, 21 nt, Artificial Sequence
  Marburg virus siRNA sense strand
gguuaagaguaugguaccgug

SEQ ID NO: 32132 - RNA, 21 nt, Artificial Sequence
  Marburg virus siRNA sense strand
guuaagaguaugguaccguga

SEQ ID NO: 32133 - RNA, 21 nt, Artificial Sequence
  Marburg virus siRNA sense strand
uuaagaguaugguaccgugac

SEQ ID NO: 32134 - RNA, 21 nt, Artificial Sequence
  Marburg virus siRNA sense strand
uaagaguaugguaccgugacc

SEQ ID NO: 32135 - RNA, 21 nt, Artificial Sequence
  Marburg virus siRNA sense strand
aagaguaugguaccgugacca

SEQ ID NO: 32136 - RNA, 21 nt, Artificial Sequence
  Marburg virus siRNA sense strand
agaguaugguaccgugaccaa

SEQ ID NO: 32137 - RNA, 21 nt, Artificial Sequence
  Marburg virus siRNA sense strand
gaguaugguaccgugaccaaa

SEQ ID NO: 32138 - RNA, 21 nt, Artificial Sequence
  Marburg virus siRNA sense strand
aguaugguaccgugaccaaaa

SEQ ID NO: 32139 - RNA, 21 nt, Artificial Sequence
  Marburg virus siRNA sense strand
guaugguaccgugaccaaaac

SEQ ID NO: 32140 - RNA, 21 nt, Artificial Sequence
  Marburg virus siRNA sense strand
uaugguaccgugaccaaaacu

SEQ ID NO: 32141 - RNA, 21 nt, Artificial Sequence
  Marburg virus siRNA sense strand
augguaccgugaccaaaacuu

SEQ ID NO: 32142 - RNA, 21 nt, Artificial Sequence
  Marburg virus siRNA sense strand
ugguaccgugaccaaaacuug

SEQ ID NO: 32143 - RNA, 21 nt, Artificial Sequence
  Marburg virus siRNA sense strand
gguaccgugaccaaaacuuga

SEQ ID NO: 32144 - RNA, 21 nt, Artificial Sequence
  Marburg virus siRNA sense strand
guaccgugaccaaaacuugac

SEQ ID NO: 32145 - RNA, 21 nt, Artificial Sequence
  Marburg virus siRNA sense strand
uaccgugaccaaaacuugacc

SEQ ID NO: 32146 - RNA, 21 nt, Artificial Sequence
  Marburg virus siRNA sense strand
accgugaccaaaacuugaccc

SEQ ID NO: 32147 - RNA, 21 nt, Artificial Sequence
  Marburg virus siRNA sense strand
ccgugaccaaaacuugacccc

SEQ ID NO: 32148 - RNA, 21 nt, Artificial Sequence
  Marburg virus siRNA sense strand
cgugaccaaaacuugaccccu

SEQ ID NO: 32149 - RNA, 21 nt, Artificial Sequence
  Marburg virus siRNA sense strand
gugaccaaaacuugaccccuu

SEQ ID NO: 32150 - RNA, 21 nt, Artificial Sequence
  Marburg virus siRNA sense strand
ugaccaaaacuugaccccuua

SEQ ID NO: 32151 - RNA, 21 nt, Artificial Sequence
  Marburg virus siRNA sense strand
gaccaaaacuugaccccuuau

SEQ ID NO: 32152 - RNA, 21 nt, Artificial Sequence
  Marburg virus siRNA sense strand
accaaaacuugaccccuuauc

SEQ ID NO: 32153 - RNA, 21 nt, Artificial Sequence
  Marburg virus siRNA sense strand
ccaaaacuugaccccuuaucu

SEQ ID NO: 32154 - RNA, 21 nt, Artificial Sequence
  Marburg virus siRNA sense strand
caaaacuugaccccuuaucua

SEQ ID NO: 32155 - RNA, 21 nt, Artificial Sequence
  Marburg virus siRNA sense strand
aaaacuugaccccuuaucuau

SEQ ID NO: 32156 - RNA, 21 nt, Artificial Sequence
  Marburg virus siRNA sense strand
aaacuugaccccuuaucuaug

SEQ ID NO: 32157 - RNA, 21 nt, Artificial Sequence
  Marburg virus siRNA sense strand
aacuugaccccuuaucuaugc

SEQ ID NO: 32158 - RNA, 21 nt, Artificial Sequence
  Marburg virus siRNA sense strand
acuugaccccuuaucuaugcg

SEQ ID NO: 32159 - RNA, 21 nt, Artificial Sequence
  Marburg virus siRNA sense strand
cuugaccccuuaucuaugcga

SEQ ID NO: 32160 - RNA, 21 nt, Artificial Sequence
  Marburg virus siRNA sense strand
uugaccccuuaucuaugcgau

SEQ ID NO: 32161 - RNA, 21 nt, Artificial Sequence
  Marburg virus siRNA sense strand
ugaccccuuaucuaugcgaug

SEQ ID NO: 32162 - RNA, 21 nt, Artificial Sequence
  Marburg virus siRNA sense strand
gaccccuuaucuaugcgauga

SEQ ID NO: 32163 - RNA, 21 nt, Artificial Sequence
  Marburg virus siRNA sense strand
accccuuaucuaugcgaugau

SEQ ID NO: 32164 - RNA, 21 nt, Artificial Sequence
  Marburg virus siRNA sense strand
ccccuuaucuaugcgaugaug

SEQ ID NO: 32165 - RNA, 21 nt, Artificial Sequence
  Marburg virus siRNA sense strand
cccuuaucuaugcgaugauga

SEQ ID NO: 32166 - RNA, 21 nt, Artificial Sequence
  Marburg virus siRNA sense strand
ccuuaucuaugcgaugaugag

SEQ ID NO: 32167 - RNA, 21 nt, Artificial Sequence
  Marburg virus siRNA sense strand
cuuaucuaugcgaugaugagu

SEQ ID NO: 32168 - RNA, 21 nt, Artificial Sequence
  Marburg virus siRNA sense strand
uuaucuaugcgaugaugaguu

SEQ ID NO: 32169 - RNA, 21 nt, Artificial Sequence
  Marburg virus siRNA sense strand
uaucuaugcgaugaugaguuu

SEQ ID NO: 32170 - RNA, 21 nt, Artificial Sequence
  Marburg virus siRNA sense strand
aucuaugcgaugaugaguuua

SEQ ID NO: 32171 - RNA, 21 nt, Artificial Sequence
  Marburg virus siRNA sense strand
ucuaugcgaugaugaguuuau

SEQ ID NO: 32172 - RNA, 21 nt, Artificial Sequence
  Marburg virus siRNA sense strand
cuaugcgaugaugaguuuauu

SEQ ID NO: 32173 - RNA, 21 nt, Artificial Sequence
  Marburg virus siRNA sense strand
uaugcgaugaugaguuuauug

SEQ ID NO: 32174 - RNA, 21 nt, Artificial Sequence
  Marburg virus siRNA sense strand
augcgaugaugaguuuauugu

SEQ ID NO: 32175 - RNA, 21 nt, Artificial Sequence
  Marburg virus siRNA sense strand
ugcgaugaugaguuuauugua

SEQ ID NO: 32176 - RNA, 21 nt, Artificial Sequence
  Marburg virus siRNA sense strand
gcgaugaugaguuuauuguaa

SEQ ID NO: 32177 - RNA, 21 nt, Artificial Sequence
  Marburg virus siRNA sense strand
cgaugaugaguuuauuguaag

SEQ ID NO: 32178 - RNA, 21 nt, Artificial Sequence
  Marburg virus siRNA sense strand
gaugaugaguuuauuguaagc

SEQ ID NO: 32179 - RNA, 21 nt, Artificial Sequence
  Marburg virus siRNA sense strand
augaugaguuuauuguaagcg

SEQ ID NO: 32180 - RNA, 21 nt, Artificial Sequence
  Marburg virus siRNA sense strand
ugaugaguuuauuguaagcgu

SEQ ID NO: 32181 - RNA, 21 nt, Artificial Sequence
  Marburg virus siRNA sense strand
gaugaguuuauuguaagcguc

SEQ ID NO: 32182 - RNA, 21 nt, Artificial Sequence
  Marburg virus siRNA sense strand
augaguuuauuguaagcgucg

SEQ ID NO: 32183 - RNA, 21 nt, Artificial Sequence
  Marburg virus siRNA sense strand
ugaguuuauuguaagcgucgc

SEQ ID NO: 32184 - RNA, 21 nt, Artificial Sequence
  Marburg virus siRNA sense strand
gaguuuauuguaagcgucgcu

SEQ ID NO: 32185 - RNA, 21 nt, Artificial Sequence
  Marburg virus siRNA sense strand
aguuuauuguaagcgucgcua

SEQ ID NO: 32186 - RNA, 21 nt, Artificial Sequence
  Marburg virus siRNA sense strand
guuuauuguaagcgucgcuag

SEQ ID NO: 32187 - RNA, 21 nt, Artificial Sequence
  Marburg virus siRNA sense strand
uuuauuguaagcgucgcuagu

SEQ ID NO: 32188 - RNA, 21 nt, Artificial Sequence
  Marburg virus siRNA sense strand
uuauuguaagcgucgcuaguu

SEQ ID NO: 32189 - RNA, 21 nt, Artificial Sequence
  Marburg virus siRNA sense strand
uauuguaagcgucgcuaguua

SEQ ID NO: 32190 - RNA, 21 nt, Artificial Sequence
  Marburg virus siRNA sense strand
auuguaagcgucgcuaguuau

SEQ ID NO: 32191 - RNA, 21 nt, Artificial Sequence
  Marburg virus siRNA sense strand
uuguaagcgucgcuaguuaug

SEQ ID NO: 32192 - RNA, 21 nt, Artificial Sequence
  Marburg virus siRNA sense strand
uguaagcgucgcuaguuauga

SEQ ID NO: 32193 - RNA, 21 nt, Artificial Sequence
  Marburg virus siRNA sense strand
guaagcgucgcuaguuaugaa

SEQ ID NO: 32194 - RNA, 21 nt, Artificial Sequence
  Marburg virus siRNA sense strand
uaagcgucgcuaguuaugaau

SEQ ID NO: 32195 - RNA, 21 nt, Artificial Sequence
  Marburg virus siRNA sense strand
aagcgucgcuaguuaugaaug

SEQ ID NO: 32196 - RNA, 21 nt, Artificial Sequence
  Marburg virus siRNA sense strand
agcgucgcuaguuaugaaugu

SEQ ID NO: 32197 - RNA, 21 nt, Artificial Sequence
  Marburg virus siRNA sense strand
gcgucgcuaguuaugaauguu

SEQ ID NO: 32198 - RNA, 21 nt, Artificial Sequence
  Marburg virus siRNA sense strand
cgucgcuaguuaugaauguuu

SEQ ID NO: 32199 - RNA, 21 nt, Artificial Sequence
  Marburg virus siRNA sense strand
gucgcuaguuaugaauguuuu

SEQ ID NO: 32200 - RNA, 21 nt, Artificial Sequence
  Marburg virus siRNA sense strand
ucgcuaguuaugaauguuuua

SEQ ID NO: 32201 - RNA, 21 nt, Artificial Sequence
  Marburg virus siRNA sense strand
cgcuaguuaugaauguuuuau

SEQ ID NO: 32202 - RNA, 21 nt, Artificial Sequence
  Marburg virus siRNA sense strand
gcuaguuaugaauguuuuauc

SEQ ID NO: 32203 - RNA, 21 nt, Artificial Sequence
  Marburg virus siRNA sense strand
cuaguuaugaauguuuuauca

SEQ ID NO: 32204 - RNA, 21 nt, Artificial Sequence
  Marburg virus siRNA sense strand
uaguuaugaauguuuuaucau

SEQ ID NO: 32205 - RNA, 21 nt, Artificial Sequence
  Marburg virus siRNA sense strand
aguuaugaauguuuuaucaug

SEQ ID NO: 32206 - RNA, 21 nt, Artificial Sequence
  Marburg virus siRNA sense strand
guuaugaauguuuuaucauga

SEQ ID NO: 32207 - RNA, 21 nt, Artificial Sequence
  Marburg virus siRNA sense strand
uuaugaauguuuuaucaugau

SEQ ID NO: 32208 - RNA, 21 nt, Artificial Sequence
  Marburg virus siRNA sense strand
uaugaauguuuuaucaugauu

SEQ ID NO: 32209 - RNA, 21 nt, Artificial Sequence
  Marburg virus siRNA sense strand
augaauguuuuaucaugauua

SEQ ID NO: 32210 - RNA, 21 nt, Artificial Sequence
  Marburg virus siRNA sense strand
ugaauguuuuaucaugauuaa

SEQ ID NO: 32211 - RNA, 21 nt, Artificial Sequence
  Marburg virus siRNA sense strand
gaauguuuuaucaugauuaaa

SEQ ID NO: 32212 - RNA, 21 nt, Artificial Sequence
  Marburg virus siRNA sense strand
aauguuuuaucaugauuaaag

SEQ ID NO: 32213 - RNA, 21 nt, Artificial Sequence
  Marburg virus siRNA sense strand
auguuuuaucaugauuaaaga

SEQ ID NO: 32214 - RNA, 21 nt, Artificial Sequence
  Marburg virus siRNA sense strand
uguuuuaucaugauuaaagac

SEQ ID NO: 32215 - RNA, 21 nt, Artificial Sequence
  Marburg virus siRNA sense strand
guuuuaucaugauuaaagacg

SEQ ID NO: 32216 - RNA, 21 nt, Artificial Sequence
  Marburg virus siRNA sense strand
uuuuaucaugauuaaagacgu

SEQ ID NO: 32217 - RNA, 21 nt, Artificial Sequence
  Marburg virus siRNA sense strand
uuuaucaugauuaaagacguc

SEQ ID NO: 32218 - RNA, 21 nt, Artificial Sequence
  Marburg virus siRNA sense strand
uuaucaugauuaaagacgucu

SEQ ID NO: 32219 - RNA, 21 nt, Artificial Sequence
  Marburg virus siRNA sense strand
uaucaugauuaaagacgucuu

SEQ ID NO: 32220 - RNA, 21 nt, Artificial Sequence
  Marburg virus siRNA sense strand
aucaugauuaaagacgucuuc

SEQ ID NO: 32221 - RNA, 21 nt, Artificial Sequence
  Marburg virus siRNA sense strand
ucaugauuaaagacgucuuca

SEQ ID NO: 32222 - RNA, 21 nt, Artificial Sequence
  Marburg virus siRNA sense strand
caugauuaaagacgucuucau

SEQ ID NO: 32223 - RNA, 21 nt, Artificial Sequence
  Marburg virus siRNA sense strand
augauuaaagacgucuucauu

SEQ ID NO: 32224 - RNA, 21 nt, Artificial Sequence
  Marburg virus siRNA sense strand
ugauuaaagacgucuucauug

SEQ ID NO: 32225 - RNA, 21 nt, Artificial Sequence
  Marburg virus siRNA sense strand
gauuaaagacgucuucauuga

SEQ ID NO: 32226 - RNA, 21 nt, Artificial Sequence
  Marburg virus siRNA sense strand
auuaaagacgucuucauugag

SEQ ID NO: 32227 - RNA, 21 nt, Artificial Sequence
  Marburg virus siRNA sense strand
uuaaagacgucuucauugaga

SEQ ID NO: 32228 - RNA, 21 nt, Artificial Sequence
  Marburg virus siRNA sense strand
uaaagacgucuucauugagag

SEQ ID NO: 32229 - RNA, 21 nt, Artificial Sequence
  Marburg virus siRNA sense strand
aaagacgucuucauugagagg

SEQ ID NO: 32230 - RNA, 21 nt, Artificial Sequence
  Marburg virus siRNA sense strand
aagacgucuucauugagaggu

SEQ ID NO: 32231 - RNA, 21 nt, Artificial Sequence
  Marburg virus siRNA sense strand
agacgucuucauugagaggua

SEQ ID NO: 32232 - RNA, 21 nt, Artificial Sequence
  Marburg virus siRNA sense strand
gacgucuucauugagagguau

SEQ ID NO: 32233 - RNA, 21 nt, Artificial Sequence
  Marburg virus siRNA sense strand
acgucuucauugagagguaua

SEQ ID NO: 32234 - RNA, 21 nt, Artificial Sequence
  Marburg virus siRNA sense strand
cgucuucauugagagguauaa

SEQ ID NO: 32235 - RNA, 21 nt, Artificial Sequence
  Marburg virus siRNA sense strand
gucuucauugagagguauaac

SEQ ID NO: 32236 - RNA, 21 nt, Artificial Sequence
  Marburg virus siRNA sense strand
ucuucauugagagguauaaca

SEQ ID NO: 32237 - RNA, 21 nt, Artificial Sequence
  Marburg virus siRNA sense strand
cuucauugagagguauaacac

SEQ ID NO: 32238 - RNA, 21 nt, Artificial Sequence
  Marburg virus siRNA sense strand
uucauugagagguauaacacg

SEQ ID NO: 32239 - RNA, 21 nt, Artificial Sequence
  Marburg virus siRNA sense strand
ucauugagagguauaacacgu

SEQ ID NO: 32240 - RNA, 21 nt, Artificial Sequence
  Marburg virus siRNA sense strand
cauugagagguauaacacgug

SEQ ID NO: 32241 - RNA, 21 nt, Artificial Sequence
  Marburg virus siRNA sense strand
auugagagguauaacacgugg

SEQ ID NO: 32242 - RNA, 21 nt, Artificial Sequence
  Marburg virus siRNA sense strand
uugagagguauaacacguggg

SEQ ID NO: 32243 - RNA, 21 nt, Artificial Sequence
  Marburg virus siRNA sense strand
ugagagguauaacacguggga

SEQ ID NO: 32244 - RNA, 21 nt, Artificial Sequence
  Marburg virus siRNA sense strand
gagagguauaacacgugggaa

SEQ ID NO: 32245 - RNA, 21 nt, Artificial Sequence
  Marburg virus siRNA sense strand
agagguauaacacgugggaaa

SEQ ID NO: 32246 - RNA, 21 nt, Artificial Sequence
  Marburg virus siRNA sense strand
gagguauaacacgugggaaau

SEQ ID NO: 32247 - RNA, 21 nt, Artificial Sequence
  Marburg virus siRNA sense strand
agguauaacacgugggaaaua

SEQ ID NO: 32248 - RNA, 21 nt, Artificial Sequence
  Marburg virus siRNA sense strand
gguauaacacgugggaaauau

SEQ ID NO: 32249 - RNA, 21 nt, Artificial Sequence
  Marburg virus siRNA sense strand
guauaacacgugggaaauaug

SEQ ID NO: 32250 - RNA, 21 nt, Artificial Sequence
  Marburg virus siRNA sense strand
uauaacacgugggaaauaugu

SEQ ID NO: 32251 - RNA, 21 nt, Artificial Sequence
  Marburg virus siRNA sense strand
auaacacgugggaaauaugug

SEQ ID NO: 32252 - RNA, 21 nt, Artificial Sequence
  Marburg virus siRNA sense strand
uaacacgugggaaauaugugc

SEQ ID NO: 32253 - RNA, 21 nt, Artificial Sequence
  Marburg virus siRNA sense strand
aacacgugggaaauaugugcc

SEQ ID NO: 32254 - RNA, 21 nt, Artificial Sequence
  Marburg virus siRNA sense strand
acacgugggaaauaugugccc

SEQ ID NO: 32255 - RNA, 21 nt, Artificial Sequence
  Marburg virus siRNA sense strand
cacgugggaaauaugugcccg

SEQ ID NO: 32256 - RNA, 21 nt, Artificial Sequence
  Marburg virus siRNA sense strand
acgugggaaauaugugcccgc

SEQ ID NO: 32257 - RNA, 21 nt, Artificial Sequence
  Marburg virus siRNA sense strand
cgugggaaauaugugcccgcg

SEQ ID NO: 32258 - RNA, 21 nt, Artificial Sequence
  Marburg virus siRNA sense strand
gugggaaauaugugcccgcgc

SEQ ID NO: 32259 - RNA, 21 nt, Artificial Sequence
  Marburg virus siRNA sense strand
ugggaaauaugugcccgcgcc

SEQ ID NO: 32260 - RNA, 21 nt, Artificial Sequence
  Marburg virus siRNA sense strand
gggaaauaugugcccgcgccu

SEQ ID NO: 32261 - RNA, 21 nt, Artificial Sequence
  Marburg virus siRNA sense strand
ggaaauaugugcccgcgccug

SEQ ID NO: 32262 - RNA, 21 nt, Artificial Sequence
  Marburg virus siRNA sense strand
gaaauaugugcccgcgccugg

SEQ ID NO: 32263 - RNA, 21 nt, Artificial Sequence
  Marburg virus siRNA sense strand
aaauaugugcccgcgccuggc

SEQ ID NO: 32264 - RNA, 21 nt, Artificial Sequence
  Marburg virus siRNA sense strand
aauaugugcccgcgccuggcu

SEQ ID NO: 32265 - RNA, 21 nt, Artificial Sequence
  Marburg virus siRNA sense strand
auaugugcccgcgccuggcuc

SEQ ID NO: 32266 - RNA, 21 nt, Artificial Sequence
  Marburg virus siRNA sense strand
uaugugcccgcgccuggcucg

SEQ ID NO: 32267 - RNA, 21 nt, Artificial Sequence
  Marburg virus siRNA sense strand
augugcccgcgccuggcucga

SEQ ID NO: 32268 - RNA, 21 nt, Artificial Sequence
  Marburg virus siRNA sense strand
ugugcccgcgccuggcucgaa

SEQ ID NO: 32269 - RNA, 21 nt, Artificial Sequence
  Marburg virus siRNA sense strand
gugcccgcgccuggcucgaag

SEQ ID NO: 32270 - RNA, 21 nt, Artificial Sequence
  Marburg virus siRNA sense strand
ugcccgcgccuggcucgaaga

SEQ ID NO: 32271 - RNA, 21 nt, Artificial Sequence
  Marburg virus siRNA sense strand
gcccgcgccuggcucgaagac

SEQ ID NO: 32272 - RNA, 21 nt, Artificial Sequence
  Marburg virus siRNA sense strand
cccgcgccuggcucgaagaca

SEQ ID NO: 32273 - RNA, 21 nt, Artificial Sequence
  Marburg virus siRNA sense strand
ccgcgccuggcucgaagacag

SEQ ID NO: 32274 - RNA, 21 nt, Artificial Sequence
  Marburg virus siRNA sense strand
cgcgccuggcucgaagacagu

SEQ ID NO: 32275 - RNA, 21 nt, Artificial Sequence
  Marburg virus siRNA sense strand
gcgccuggcucgaagacagug

SEQ ID NO: 32276 - RNA, 21 nt, Artificial Sequence
  Marburg virus siRNA sense strand
cgccuggcucgaagacaguga

SEQ ID NO: 32277 - RNA, 21 nt, Artificial Sequence
  Marburg virus siRNA sense strand
gccuggcucgaagacagugau

SEQ ID NO: 32278 - RNA, 21 nt, Artificial Sequence
  Marburg virus siRNA sense strand
ccuggcucgaagacagugaug

SEQ ID NO: 32279 - RNA, 21 nt, Artificial Sequence
  Marburg virus siRNA sense strand
cuggcucgaagacagugaugg

SEQ ID NO: 32280 - RNA, 21 nt, Artificial Sequence
  Marburg virus siRNA sense strand
uggcucgaagacagugaugga

SEQ ID NO: 32281 - RNA, 21 nt, Artificial Sequence
  Marburg virus siRNA sense strand
ggcucgaagacagugauggag

SEQ ID NO: 32282 - RNA, 21 nt, Artificial Sequence
  Marburg virus siRNA sense strand
gcucgaagacagugauggagc

SEQ ID NO: 32283 - RNA, 21 nt, Artificial Sequence
  Marburg virus siRNA sense strand
cucgaagacagugauggagcu

SEQ ID NO: 32284 - RNA, 21 nt, Artificial Sequence
  Marburg virus siRNA sense strand
ucgaagacagugauggagcug

SEQ ID NO: 32285 - RNA, 21 nt, Artificial Sequence
  Marburg virus siRNA sense strand
cgaagacagugauggagcuga

SEQ ID NO: 32286 - RNA, 21 nt, Artificial Sequence
  Marburg virus siRNA sense strand
gaagacagugauggagcugau

SEQ ID NO: 32287 - RNA, 21 nt, Artificial Sequence
  Marburg virus siRNA sense strand
aagacagugauggagcugauu

SEQ ID NO: 32288 - RNA, 21 nt, Artificial Sequence
  Marburg virus siRNA sense strand
agacagugauggagcugauua

SEQ ID NO: 32289 - RNA, 21 nt, Artificial Sequence
  Marburg virus siRNA sense strand
gacagugauggagcugauuau

SEQ ID NO: 32290 - RNA, 21 nt, Artificial Sequence
  Marburg virus siRNA sense strand
acagugauggagcugauuauc

SEQ ID NO: 32291 - RNA, 21 nt, Artificial Sequence
  Marburg virus siRNA sense strand
cagugauggagcugauuaucu

SEQ ID NO: 32292 - RNA, 21 nt, Artificial Sequence
  Marburg virus siRNA sense strand
agugauggagcugauuaucuc

SEQ ID NO: 32293 - RNA, 21 nt, Artificial Sequence
  Marburg virus siRNA sense strand
gugauggagcugauuaucucc

SEQ ID NO: 32294 - RNA, 21 nt, Artificial Sequence
  Marburg virus siRNA sense strand
ugauggagcugauuaucuccc

SEQ ID NO: 32295 - RNA, 21 nt, Artificial Sequence
  Marburg virus siRNA sense strand
gauggagcugauuaucucccu

SEQ ID NO: 32296 - RNA, 21 nt, Artificial Sequence
  Marburg virus siRNA sense strand
auggagcugauuaucucccuc

SEQ ID NO: 32297 - RNA, 21 nt, Artificial Sequence
  Marburg virus siRNA sense strand
uggagcugauuaucucccucu

SEQ ID NO: 32298 - RNA, 21 nt, Artificial Sequence
  Marburg virus siRNA sense strand
ggagcugauuaucucccucuu

SEQ ID NO: 32299 - RNA, 21 nt, Artificial Sequence
  Marburg virus siRNA sense strand
gagcugauuaucucccucuug

SEQ ID NO: 32300 - RNA, 21 nt, Artificial Sequence
  Marburg virus siRNA sense strand
agcugauuaucucccucuuga

SEQ ID NO: 32301 - RNA, 21 nt, Artificial Sequence
  Marburg virus siRNA sense strand
gcugauuaucucccucuugau

SEQ ID NO: 32302 - RNA, 21 nt, Artificial Sequence
  Marburg virus siRNA sense strand
cugauuaucucccucuugaug

SEQ ID NO: 32303 - RNA, 21 nt, Artificial Sequence
  Marburg virus siRNA sense strand
ugauuaucucccucuugaugu

SEQ ID NO: 32304 - RNA, 21 nt, Artificial Sequence
  Marburg virus siRNA sense strand
gauuaucucccucuugaugug

SEQ ID NO: 32305 - RNA, 21 nt, Artificial Sequence
  Marburg virus siRNA sense strand
auuaucucccucuugaugugu

SEQ ID NO: 32306 - RNA, 21 nt, Artificial Sequence
  Marburg virus siRNA sense strand
uuaucucccucuugauguguu

SEQ ID NO: 32307 - RNA, 21 nt, Artificial Sequence
  Marburg virus siRNA sense strand
uaucucccucuugauguguua

SEQ ID NO: 32308 - RNA, 21 nt, Artificial Sequence
  Marburg virus siRNA sense strand
aucucccucuugauguguuag

SEQ ID NO: 32309 - RNA, 21 nt, Artificial Sequence
  Marburg virus siRNA sense strand
ucucccucuugauguguuagg

SEQ ID NO: 32310 - RNA, 21 nt, Artificial Sequence
  Marburg virus siRNA sense strand
cucccucuugauguguuaggu

SEQ ID NO: 32311 - RNA, 21 nt, Artificial Sequence
  Marburg virus siRNA sense strand
ucccucuugauguguuaggug

SEQ ID NO: 32312 - RNA, 21 nt, Artificial Sequence
  Marburg virus siRNA sense strand
cccucuugauguguuagguga

SEQ ID NO: 32313 - RNA, 21 nt, Artificial Sequence
  Marburg virus siRNA sense strand
ccucuugauguguuaggugag

SEQ ID NO: 32314 - RNA, 21 nt, Artificial Sequence
  Marburg virus siRNA sense strand
cucuugauguguuaggugagu

SEQ ID NO: 32315 - RNA, 21 nt, Artificial Sequence
  Marburg virus siRNA sense strand
ucuugauguguuaggugaguu

SEQ ID NO: 32316 - RNA, 21 nt, Artificial Sequence
  Marburg virus siRNA sense strand
cuugauguguuaggugaguua

SEQ ID NO: 32317 - RNA, 21 nt, Artificial Sequence
  Marburg virus siRNA sense strand
uugauguguuaggugaguuau

SEQ ID NO: 32318 - RNA, 21 nt, Artificial Sequence
  Marburg virus siRNA sense strand
ugauguguuaggugaguuaua

SEQ ID NO: 32319 - RNA, 21 nt, Artificial Sequence
  Marburg virus siRNA sense strand
gauguguuaggugaguuauac

SEQ ID NO: 32320 - RNA, 21 nt, Artificial Sequence
  Marburg virus siRNA sense strand
auguguuaggugaguuauaca

SEQ ID NO: 32321 - RNA, 21 nt, Artificial Sequence
  Marburg virus siRNA sense strand
uguguuaggugaguuauacaa

SEQ ID NO: 32322 - RNA, 21 nt, Artificial Sequence
  Marburg virus siRNA sense strand
guguuaggugaguuauacaac

SEQ ID NO: 32323 - RNA, 21 nt, Artificial Sequence
  Marburg virus siRNA sense strand
uguuaggugaguuauacaacc

SEQ ID NO: 32324 - RNA, 21 nt, Artificial Sequence
  Marburg virus siRNA sense strand
guuaggugaguuauacaacca

SEQ ID NO: 32325 - RNA, 21 nt, Artificial Sequence
  Marburg virus siRNA sense strand
uuaggugaguuauacaaccag

SEQ ID NO: 32326 - RNA, 21 nt, Artificial Sequence
  Marburg virus siRNA sense strand
uaggugaguuauacaaccagg

SEQ ID NO: 32327 - RNA, 21 nt, Artificial Sequence
  Marburg virus siRNA sense strand
aggugaguuauacaaccaggg

SEQ ID NO: 32328 - RNA, 21 nt, Artificial Sequence
  Marburg virus siRNA sense strand
ggugaguuauacaaccaggga

SEQ ID NO: 32329 - RNA, 21 nt, Artificial Sequence
  Marburg virus siRNA sense strand
gugaguuauacaaccagggag

SEQ ID NO: 32330 - RNA, 21 nt, Artificial Sequence
  Marburg virus siRNA sense strand
ugaguuauacaaccagggaga

SEQ ID NO: 32331 - RNA, 21 nt, Artificial Sequence
  Marburg virus siRNA sense strand
gaguuauacaaccagggagau

SEQ ID NO: 32332 - RNA, 21 nt, Artificial Sequence
  Marburg virus siRNA sense strand
aguuauacaaccagggagauc

SEQ ID NO: 32333 - RNA, 21 nt, Artificial Sequence
  Marburg virus siRNA sense strand
guuauacaaccagggagauca

SEQ ID NO: 32334 - RNA, 21 nt, Artificial Sequence
  Marburg virus siRNA sense strand
uuauacaaccagggagaucaa

SEQ ID NO: 32335 - RNA, 21 nt, Artificial Sequence
  Marburg virus siRNA sense strand
uauacaaccagggagaucaaa

SEQ ID NO: 32336 - RNA, 21 nt, Artificial Sequence
  Marburg virus siRNA sense strand
auacaaccagggagaucaaau

SEQ ID NO: 32337 - RNA, 21 nt, Artificial Sequence
  Marburg virus siRNA sense strand
uacaaccagggagaucaaauu

SEQ ID NO: 32338 - RNA, 21 nt, Artificial Sequence
  Marburg virus siRNA sense strand
acaaccagggagaucaaauua

SEQ ID NO: 32339 - RNA, 21 nt, Artificial Sequence
  Marburg virus siRNA sense strand
caaccagggagaucaaauuau

SEQ ID NO: 32340 - RNA, 21 nt, Artificial Sequence
  Marburg virus siRNA sense strand
aaccagggagaucaaauuauu

SEQ ID NO: 32341 - RNA, 21 nt, Artificial Sequence
  Marburg virus siRNA sense strand
accagggagaucaaauuauug

SEQ ID NO: 32342 - RNA, 21 nt, Artificial Sequence
  Marburg virus siRNA sense strand
ccagggagaucaaauuauugc

SEQ ID NO: 32343 - RNA, 21 nt, Artificial Sequence
  Marburg virus siRNA sense strand
cagggagaucaaauuauugcc

SEQ ID NO: 32344 - RNA, 21 nt, Artificial Sequence
  Marburg virus siRNA sense strand
agggagaucaaauuauugcca

SEQ ID NO: 32345 - RNA, 21 nt, Artificial Sequence
  Marburg virus siRNA sense strand
gggagaucaaauuauugccau

SEQ ID NO: 32346 - RNA, 21 nt, Artificial Sequence
  Marburg virus siRNA sense strand
ggagaucaaauuauugccaug

SEQ ID NO: 32347 - RNA, 21 nt, Artificial Sequence
  Marburg virus siRNA sense strand
gagaucaaauuauugccaugu

SEQ ID NO: 32348 - RNA, 21 nt, Artificial Sequence
  Marburg virus siRNA sense strand
agaucaaauuauugccaugua

SEQ ID NO: 32349 - RNA, 21 nt, Artificial Sequence
  Marburg virus siRNA sense strand
gaucaaauuauugccauguac

SEQ ID NO: 32350 - RNA, 21 nt, Artificial Sequence
  Marburg virus siRNA sense strand
aucaaauuauugccauguacu

SEQ ID NO: 32351 - RNA, 21 nt, Artificial Sequence
  Marburg virus siRNA sense strand
ucaaauuauugccauguacuu

SEQ ID NO: 32352 - RNA, 21 nt, Artificial Sequence
  Marburg virus siRNA sense strand
caaauuauugccauguacuug

SEQ ID NO: 32353 - RNA, 21 nt, Artificial Sequence
  Marburg virus siRNA sense strand
aaauuauugccauguacuugg

SEQ ID NO: 32354 - RNA, 21 nt, Artificial Sequence
  Marburg virus siRNA sense strand
aauuauugccauguacuugga

SEQ ID NO: 32355 - RNA, 21 nt, Artificial Sequence
  Marburg virus siRNA sense strand
auuauugccauguacuuggaa

SEQ ID NO: 32356 - RNA, 21 nt, Artificial Sequence
  Marburg virus siRNA sense strand
uuauugccauguacuuggaag

SEQ ID NO: 32357 - RNA, 21 nt, Artificial Sequence
  Marburg virus siRNA sense strand
uauugccauguacuuggaaga

SEQ ID NO: 32358 - RNA, 21 nt, Artificial Sequence
  Marburg virus siRNA sense strand
auugccauguacuuggaagac

SEQ ID NO: 32359 - RNA, 21 nt, Artificial Sequence
  Marburg virus siRNA sense strand
uugccauguacuuggaagacg

SEQ ID NO: 32360 - RNA, 21 nt, Artificial Sequence
  Marburg virus siRNA sense strand
ugccauguacuuggaagacgg

SEQ ID NO: 32361 - RNA, 21 nt, Artificial Sequence
  Marburg virus siRNA sense strand
gccauguacuuggaagacggu

SEQ ID NO: 32362 - RNA, 21 nt, Artificial Sequence
  Marburg virus siRNA sense strand
ccauguacuuggaagacgguu

SEQ ID NO: 32363 - RNA, 21 nt, Artificial Sequence
  Marburg virus siRNA sense strand
cauguacuuggaagacgguuu

SEQ ID NO: 32364 - RNA, 21 nt, Artificial Sequence
  Marburg virus siRNA sense strand
auguacuuggaagacgguuuc

SEQ ID NO: 32365 - RNA, 21 nt, Artificial Sequence
  Marburg virus siRNA sense strand
uguacuuggaagacgguuuca

SEQ ID NO: 32366 - RNA, 21 nt, Artificial Sequence
  Marburg virus siRNA sense strand
guacuuggaagacgguuucaa

SEQ ID NO: 32367 - RNA, 21 nt, Artificial Sequence
  Marburg virus siRNA sense strand
uacuuggaagacgguuucaaa

SEQ ID NO: 32368 - RNA, 21 nt, Artificial Sequence
  Marburg virus siRNA sense strand
acuuggaagacgguuucaaau

SEQ ID NO: 32369 - RNA, 21 nt, Artificial Sequence
  Marburg virus siRNA sense strand
cuuggaagacgguuucaaauu

SEQ ID NO: 32370 - RNA, 21 nt, Artificial Sequence
  Marburg virus siRNA sense strand
uuggaagacgguuucaaauug

SEQ ID NO: 32371 - RNA, 21 nt, Artificial Sequence
  Marburg virus siRNA sense strand
uggaagacgguuucaaauuga

SEQ ID NO: 32372 - RNA, 21 nt, Artificial Sequence
  Marburg virus siRNA sense strand
ggaagacgguuucaaauugau

SEQ ID NO: 32373 - RNA, 21 nt, Artificial Sequence
  Marburg virus siRNA sense strand
gaagacgguuucaaauugauc

SEQ ID NO: 32374 - RNA, 21 nt, Artificial Sequence
  Marburg virus siRNA sense strand
aagacgguuucaaauugauca

SEQ ID NO: 32375 - RNA, 21 nt, Artificial Sequence
  Marburg virus siRNA sense strand
agacgguuucaaauugaucaa

SEQ ID NO: 32376 - RNA, 21 nt, Artificial Sequence
  Marburg virus siRNA sense strand
gacgguuucaaauugaucaaa

SEQ ID NO: 32377 - RNA, 21 nt, Artificial Sequence
  Marburg virus siRNA sense strand
acgguuucaaauugaucaaac

SEQ ID NO: 32378 - RNA, 21 nt, Artificial Sequence
  Marburg virus siRNA sense strand
cgguuucaaauugaucaaaca

SEQ ID NO: 32379 - RNA, 21 nt, Artificial Sequence
  Marburg virus siRNA sense strand
gguuucaaauugaucaaacac

SEQ ID NO: 32380 - RNA, 21 nt, Artificial Sequence
  Marburg virus siRNA sense strand
guuucaaauugaucaaacacu

SEQ ID NO: 32381 - RNA, 21 nt, Artificial Sequence
  Marburg virus siRNA sense strand
uuucaaauugaucaaacacuu

SEQ ID NO: 32382 - RNA, 21 nt, Artificial Sequence
  Marburg virus siRNA sense strand
uucaaauugaucaaacacuug

SEQ ID NO: 32383 - RNA, 21 nt, Artificial Sequence
  Marburg virus siRNA sense strand
ucaaauugaucaaacacuugg

SEQ ID NO: 32384 - RNA, 21 nt, Artificial Sequence
  Marburg virus siRNA sense strand
caaauugaucaaacacuugga

SEQ ID NO: 32385 - RNA, 21 nt, Artificial Sequence
  Marburg virus siRNA sense strand
aaauugaucaaacacuuggaa

SEQ ID NO: 32386 - RNA, 21 nt, Artificial Sequence
  Marburg virus siRNA sense strand
aauugaucaaacacuuggaac

SEQ ID NO: 32387 - RNA, 21 nt, Artificial Sequence
  Marburg virus siRNA sense strand
auugaucaaacacuuggaacc

SEQ ID NO: 32388 - RNA, 21 nt, Artificial Sequence
  Marburg virus siRNA sense strand
uugaucaaacacuuggaaccc

SEQ ID NO: 32389 - RNA, 21 nt, Artificial Sequence
  Marburg virus siRNA sense strand
ugaucaaacacuuggaacccu

SEQ ID NO: 32390 - RNA, 21 nt, Artificial Sequence
  Marburg virus siRNA sense strand
gaucaaacacuuggaacccuu

SEQ ID NO: 32391 - RNA, 21 nt, Artificial Sequence
  Marburg virus siRNA sense strand
aucaaacacuuggaacccuug

SEQ ID NO: 32392 - RNA, 21 nt, Artificial Sequence
  Marburg virus siRNA sense strand
ucaaacacuuggaacccuugu

SEQ ID NO: 32393 - RNA, 21 nt, Artificial Sequence
  Marburg virus siRNA sense strand
caaacacuuggaacccuugug

SEQ ID NO: 32394 - RNA, 21 nt, Artificial Sequence
  Marburg virus siRNA sense strand
aaacacuuggaacccuugugu

SEQ ID NO: 32395 - RNA, 21 nt, Artificial Sequence
  Marburg virus siRNA sense strand
aacacuuggaacccuugugug

SEQ ID NO: 32396 - RNA, 21 nt, Artificial Sequence
  Marburg virus siRNA sense strand
acacuuggaacccuugugugu

SEQ ID NO: 32397 - RNA, 21 nt, Artificial Sequence
  Marburg virus siRNA sense strand
cacuuggaacccuuguguguc

SEQ ID NO: 32398 - RNA, 21 nt, Artificial Sequence
  Marburg virus siRNA sense strand
acuuggaacccuuguguguca

SEQ ID NO: 32399 - RNA, 21 nt, Artificial Sequence
  Marburg virus siRNA sense strand
cuuggaacccuugugugucag

SEQ ID NO: 32400 - RNA, 21 nt, Artificial Sequence
  Marburg virus siRNA sense strand
uuggaacccuugugugucagc

SEQ ID NO: 32401 - RNA, 21 nt, Artificial Sequence
  Marburg virus siRNA sense strand
uggaacccuugugugucagcu

SEQ ID NO: 32402 - RNA, 21 nt, Artificial Sequence
  Marburg virus siRNA sense strand
ggaacccuugugugucagcug

SEQ ID NO: 32403 - RNA, 21 nt, Artificial Sequence
  Marburg virus siRNA sense strand
gaacccuugugugucagcugu

SEQ ID NO: 32404 - RNA, 21 nt, Artificial Sequence
  Marburg virus siRNA sense strand
aacccuugugugucagcugua

SEQ ID NO: 32405 - RNA, 21 nt, Artificial Sequence
  Marburg virus siRNA sense strand
acccuugugugucagcuguau

SEQ ID NO: 32406 - RNA, 21 nt, Artificial Sequence
  Marburg virus siRNA sense strand
cccuugugugucagcuguaua

SEQ ID NO: 32407 - RNA, 21 nt, Artificial Sequence
  Marburg virus siRNA sense strand
ccuugugugucagcuguauac

SEQ ID NO: 32408 - RNA, 21 nt, Artificial Sequence
  Marburg virus siRNA sense strand
cuugugugucagcuguauaca

SEQ ID NO: 32409 - RNA, 21 nt, Artificial Sequence
  Marburg virus siRNA sense strand
uugugugucagcuguauacaa

SEQ ID NO: 32410 - RNA, 21 nt, Artificial Sequence
  Marburg virus siRNA sense strand
ugugugucagcuguauacaaa

SEQ ID NO: 32411 - RNA, 21 nt, Artificial Sequence
  Marburg virus siRNA sense strand
gugugucagcuguauacaaac

SEQ ID NO: 32412 - RNA, 21 nt, Artificial Sequence
  Marburg virus siRNA sense strand
ugugucagcuguauacaaaca

SEQ ID NO: 32413 - RNA, 21 nt, Artificial Sequence
  Marburg virus siRNA sense strand
gugucagcuguauacaaacac

SEQ ID NO: 32414 - RNA, 21 nt, Artificial Sequence
  Marburg virus siRNA sense strand
ugucagcuguauacaaacaca

SEQ ID NO: 32415 - RNA, 21 nt, Artificial Sequence
  Marburg virus siRNA sense strand
gucagcuguauacaaacacau

SEQ ID NO: 32416 - RNA, 21 nt, Artificial Sequence
  Marburg virus siRNA sense strand
ucagcuguauacaaacacaug

SEQ ID NO: 32417 - RNA, 21 nt, Artificial Sequence
  Marburg virus siRNA sense strand
cagcuguauacaaacacaugg

SEQ ID NO: 32418 - RNA, 21 nt, Artificial Sequence
  Marburg virus siRNA sense strand
agcuguauacaaacacauggc

SEQ ID NO: 32419 - RNA, 21 nt, Artificial Sequence
  Marburg virus siRNA sense strand
gcuguauacaaacacauggca

SEQ ID NO: 32420 - RNA, 21 nt, Artificial Sequence
  Marburg virus siRNA sense strand
cuguauacaaacacauggcau

SEQ ID NO: 32421 - RNA, 21 nt, Artificial Sequence
  Marburg virus siRNA sense strand
uguauacaaacacauggcauc

SEQ ID NO: 32422 - RNA, 21 nt, Artificial Sequence
  Marburg virus siRNA sense strand
guauacaaacacauggcaucu

SEQ ID NO: 32423 - RNA, 21 nt, Artificial Sequence
  Marburg virus siRNA sense strand
uauacaaacacauggcaucuu

SEQ ID NO: 32424 - RNA, 21 nt, Artificial Sequence
  Marburg virus siRNA sense strand
auacaaacacauggcaucuuu

SEQ ID NO: 32425 - RNA, 21 nt, Artificial Sequence
  Marburg virus siRNA sense strand
uacaaacacauggcaucuuua

SEQ ID NO: 32426 - RNA, 21 nt, Artificial Sequence
  Marburg virus siRNA sense strand
acaaacacauggcaucuuuac

SEQ ID NO: 32427 - RNA, 21 nt, Artificial Sequence
  Marburg virus siRNA sense strand
caaacacauggcaucuuuaca

SEQ ID NO: 32428 - RNA, 21 nt, Artificial Sequence
  Marburg virus siRNA sense strand
aaacacauggcaucuuuacac

SEQ ID NO: 32429 - RNA, 21 nt, Artificial Sequence
  Marburg virus siRNA sense strand
aacacauggcaucuuuacacc

SEQ ID NO: 32430 - RNA, 21 nt, Artificial Sequence
  Marburg virus siRNA sense strand
acacauggcaucuuuacacca

SEQ ID NO: 32431 - RNA, 21 nt, Artificial Sequence
  Marburg virus siRNA sense strand
cacauggcaucuuuacaccag

SEQ ID NO: 32432 - RNA, 21 nt, Artificial Sequence
  Marburg virus siRNA sense strand
acauggcaucuuuacaccagg

SEQ ID NO: 32433 - RNA, 21 nt, Artificial Sequence
  Marburg virus siRNA sense strand
cauggcaucuuuacaccagga

SEQ ID NO: 32434 - RNA, 21 nt, Artificial Sequence
  Marburg virus siRNA sense strand
auggcaucuuuacaccaggaa

SEQ ID NO: 32435 - RNA, 21 nt, Artificial Sequence
  Marburg virus siRNA sense strand
uggcaucuuuacaccaggaaa

SEQ ID NO: 32436 - RNA, 21 nt, Artificial Sequence
  Marburg virus siRNA sense strand
ggcaucuuuacaccaggaaaa

SEQ ID NO: 32437 - RNA, 21 nt, Artificial Sequence
  Marburg virus siRNA sense strand
gcaucuuuacaccaggaaaau

SEQ ID NO: 32438 - RNA, 21 nt, Artificial Sequence
  Marburg virus siRNA sense strand
caucuuuacaccaggaaaaua

SEQ ID NO: 32439 - RNA, 21 nt, Artificial Sequence
  Marburg virus siRNA sense strand
aucuuuacaccaggaaaauac

SEQ ID NO: 32440 - RNA, 21 nt, Artificial Sequence
  Marburg virus siRNA sense strand
ucuuuacaccaggaaaauacu

SEQ ID NO: 32441 - RNA, 21 nt, Artificial Sequence
  Marburg virus siRNA sense strand
cuuuacaccaggaaaauacug

SEQ ID NO: 32442 - RNA, 21 nt, Artificial Sequence
  Marburg virus siRNA sense strand
uuuacaccaggaaaauacugg

SEQ ID NO: 32443 - RNA, 21 nt, Artificial Sequence
  Marburg virus siRNA sense strand
uuacaccaggaaaauacuggu

SEQ ID NO: 32444 - RNA, 21 nt, Artificial Sequence
  Marburg virus siRNA sense strand
uacaccaggaaaauacugguu

SEQ ID NO: 32445 - RNA, 21 nt, Artificial Sequence
  Marburg virus siRNA sense strand
acaccaggaaaauacugguuc

SEQ ID NO: 32446 - RNA, 21 nt, Artificial Sequence
  Marburg virus siRNA sense strand
caccaggaaaauacugguucc

SEQ ID NO: 32447 - RNA, 21 nt, Artificial Sequence
  Marburg virus siRNA sense strand
accaggaaaauacugguucca

SEQ ID NO: 32448 - RNA, 21 nt, Artificial Sequence
  Marburg virus siRNA sense strand
ccaggaaaauacugguuccaa

SEQ ID NO: 32449 - RNA, 21 nt, Artificial Sequence
  Marburg virus siRNA sense strand
caggaaaauacugguuccaau

SEQ ID NO: 32450 - RNA, 21 nt, Artificial Sequence
  Marburg virus siRNA sense strand
aggaaaauacugguuccaauc

SEQ ID NO: 32451 - RNA, 21 nt, Artificial Sequence
  Marburg virus siRNA sense strand
ggaaaauacugguuccaauca

SEQ ID NO: 32452 - RNA, 21 nt, Artificial Sequence
  Marburg virus siRNA sense strand
gaaaauacugguuccaaucac

SEQ ID NO: 32453 - RNA, 21 nt, Artificial Sequence
  Marburg virus siRNA sense strand
aaaauacugguuccaaucaca

SEQ ID NO: 32454 - RNA, 21 nt, Artificial Sequence
  Marburg virus siRNA sense strand
aaauacugguuccaaucacag

SEQ ID NO: 32455 - RNA, 21 nt, Artificial Sequence
  Marburg virus siRNA sense strand
aauacugguuccaaucacaga

SEQ ID NO: 32456 - RNA, 21 nt, Artificial Sequence
  Marburg virus siRNA sense strand
auacugguuccaaucacagag

SEQ ID NO: 32457 - RNA, 21 nt, Artificial Sequence
  Marburg virus siRNA sense strand
uacugguuccaaucacagagg

SEQ ID NO: 32458 - RNA, 21 nt, Artificial Sequence
  Marburg virus siRNA sense strand
acugguuccaaucacagagga

SEQ ID NO: 32459 - RNA, 21 nt, Artificial Sequence
  Marburg virus siRNA sense strand
cugguuccaaucacagaggau

SEQ ID NO: 32460 - RNA, 21 nt, Artificial Sequence
  Marburg virus siRNA sense strand
ugguuccaaucacagaggauu

SEQ ID NO: 32461 - RNA, 21 nt, Artificial Sequence
  Marburg virus siRNA sense strand
gguuccaaucacagaggauug

SEQ ID NO: 32462 - RNA, 21 nt, Artificial Sequence
  Marburg virus siRNA sense strand
guuccaaucacagaggauuga

SEQ ID NO: 32463 - RNA, 21 nt, Artificial Sequence
  Marburg virus siRNA sense strand
uuccaaucacagaggauugag

SEQ ID NO: 32464 - RNA, 21 nt, Artificial Sequence
  Marburg virus siRNA sense strand
uccaaucacagaggauugagu

SEQ ID NO: 32465 - RNA, 21 nt, Artificial Sequence
  Marburg virus siRNA sense strand
ccaaucacagaggauugaguc

SEQ ID NO: 32466 - RNA, 21 nt, Artificial Sequence
  Marburg virus siRNA sense strand
caaucacagaggauugaguca

SEQ ID NO: 32467 - RNA, 21 nt, Artificial Sequence
  Marburg virus siRNA sense strand
aaucacagaggauugagucau

SEQ ID NO: 32468 - RNA, 21 nt, Artificial Sequence
  Marburg virus siRNA sense strand
aucacagaggauugagucaua

SEQ ID NO: 32469 - RNA, 21 nt, Artificial Sequence
  Marburg virus siRNA sense strand
ucacagaggauugagucauau

SEQ ID NO: 32470 - RNA, 21 nt, Artificial Sequence
  Marburg virus siRNA sense strand
cacagaggauugagucauauu

SEQ ID NO: 32471 - RNA, 21 nt, Artificial Sequence
  Marburg virus siRNA sense strand
acagaggauugagucauauua

SEQ ID NO: 32472 - RNA, 21 nt, Artificial Sequence
  Marburg virus siRNA sense strand
cagaggauugagucauauuau

SEQ ID NO: 32473 - RNA, 21 nt, Artificial Sequence
  Marburg virus siRNA sense strand
agaggauugagucauauuaug

SEQ ID NO: 32474 - RNA, 21 nt, Artificial Sequence
  Marburg virus siRNA sense strand
gaggauugagucauauuauga

SEQ ID NO: 32475 - RNA, 21 nt, Artificial Sequence
  Marburg virus siRNA sense strand
aggauugagucauauuaugag

SEQ ID NO: 32476 - RNA, 21 nt, Artificial Sequence
  Marburg virus siRNA sense strand
ggauugagucauauuaugagg

SEQ ID NO: 32477 - RNA, 21 nt, Artificial Sequence
  Marburg virus siRNA sense strand
gauugagucauauuaugagga

SEQ ID NO: 32478 - RNA, 21 nt, Artificial Sequence
  Marburg virus siRNA sense strand
auugagucauauuaugaggag

SEQ ID NO: 32479 - RNA, 21 nt, Artificial Sequence
  Marburg virus siRNA sense strand
uugagucauauuaugaggagc

SEQ ID NO: 32480 - RNA, 21 nt, Artificial Sequence
  Marburg virus siRNA sense strand
ugagucauauuaugaggagcu

SEQ ID NO: 32481 - RNA, 21 nt, Artificial Sequence
  Marburg virus siRNA sense strand
gagucauauuaugaggagcuc

SEQ ID NO: 32482 - RNA, 21 nt, Artificial Sequence
  Marburg virus siRNA sense strand
agucauauuaugaggagcucu

SEQ ID NO: 32483 - RNA, 21 nt, Artificial Sequence
  Marburg virus siRNA sense strand
gucauauuaugaggagcucug

SEQ ID NO: 32484 - RNA, 21 nt, Artificial Sequence
  Marburg virus siRNA sense strand
ucauauuaugaggagcucugu

SEQ ID NO: 32485 - RNA, 21 nt, Artificial Sequence
  Marburg virus siRNA sense strand
cauauuaugaggagcucugua

SEQ ID NO: 32486 - RNA, 21 nt, Artificial Sequence
  Marburg virus siRNA sense strand
auauuaugaggagcucuguag

SEQ ID NO: 32487 - RNA, 21 nt, Artificial Sequence
  Marburg virus siRNA sense strand
uauuaugaggagcucuguagu

SEQ ID NO: 32488 - RNA, 21 nt, Artificial Sequence
  Marburg virus siRNA sense strand
auuaugaggagcucuguaguc

SEQ ID NO: 32489 - RNA, 21 nt, Artificial Sequence
  Marburg virus siRNA sense strand
uuaugaggagcucuguagucu

SEQ ID NO: 32490 - RNA, 21 nt, Artificial Sequence
  Marburg virus siRNA sense strand
uaugaggagcucuguagucuc

SEQ ID NO: 32491 - RNA, 21 nt, Artificial Sequence
  Marburg virus siRNA sense strand
augaggagcucuguagucuca

SEQ ID NO: 32492 - RNA, 21 nt, Artificial Sequence
  Marburg virus siRNA sense strand
ugaggagcucuguagucucaa

SEQ ID NO: 32493 - RNA, 21 nt, Artificial Sequence
  Marburg virus siRNA sense strand
gaggagcucuguagucucaau

SEQ ID NO: 32494 - RNA, 21 nt, Artificial Sequence
  Marburg virus siRNA sense strand
aggagcucuguagucucaauu

SEQ ID NO: 32495 - RNA, 21 nt, Artificial Sequence
  Marburg virus siRNA sense strand
ggagcucuguagucucaauug

SEQ ID NO: 32496 - RNA, 21 nt, Artificial Sequence
  Marburg virus siRNA sense strand
gagcucuguagucucaauugg

SEQ ID NO: 32497 - RNA, 21 nt, Artificial Sequence
  Marburg virus siRNA sense strand
agcucuguagucucaauugga

SEQ ID NO: 32498 - RNA, 21 nt, Artificial Sequence
  Marburg virus siRNA sense strand
gcucuguagucucaauuggaa

SEQ ID NO: 32499 - RNA, 21 nt, Artificial Sequence
  Marburg virus siRNA sense strand
cucuguagucucaauuggaaa

SEQ ID NO: 32500 - RNA, 21 nt, Artificial Sequence
  Marburg virus siRNA sense strand
ucuguagucucaauuggaaau

SEQ ID NO: 32501 - RNA, 21 nt, Artificial Sequence
  Marburg virus siRNA sense strand
cuguagucucaauuggaaauu

SEQ ID NO: 32502 - RNA, 21 nt, Artificial Sequence
  Marburg virus siRNA sense strand
uguagucucaauuggaaauuu

SEQ ID NO: 32503 - RNA, 21 nt, Artificial Sequence
  Marburg virus siRNA sense strand
guagucucaauuggaaauuua

SEQ ID NO: 32504 - RNA, 21 nt, Artificial Sequence
  Marburg virus siRNA sense strand
uagucucaauuggaaauuuaa

SEQ ID NO: 32505 - RNA, 21 nt, Artificial Sequence
  Marburg virus siRNA sense strand
agucucaauuggaaauuuaaa

SEQ ID NO: 32506 - RNA, 21 nt, Artificial Sequence
  Marburg virus siRNA sense strand
gucucaauuggaaauuuaaaa

SEQ ID NO: 32507 - RNA, 21 nt, Artificial Sequence
  Marburg virus siRNA sense strand
ucucaauuggaaauuuaaaau

SEQ ID NO: 32508 - RNA, 21 nt, Artificial Sequence
  Marburg virus siRNA sense strand
cucaauuggaaauuuaaaauu

SEQ ID NO: 32509 - RNA, 21 nt, Artificial Sequence
  Marburg virus siRNA sense strand
ucaauuggaaauuuaaaauuu

SEQ ID NO: 32510 - RNA, 21 nt, Artificial Sequence
  Marburg virus siRNA sense strand
caauuggaaauuuaaaauuuc

SEQ ID NO: 32511 - RNA, 21 nt, Artificial Sequence
  Marburg virus siRNA sense strand
aauuggaaauuuaaaauuuca

SEQ ID NO: 32512 - RNA, 21 nt, Artificial Sequence
  Marburg virus siRNA sense strand
auuggaaauuuaaaauuucag

SEQ ID NO: 32513 - RNA, 21 nt, Artificial Sequence
  Marburg virus siRNA sense strand
uuggaaauuuaaaauuucagg

SEQ ID NO: 32514 - RNA, 21 nt, Artificial Sequence
  Marburg virus siRNA sense strand
uggaaauuuaaaauuucaggc

SEQ ID NO: 32515 - RNA, 21 nt, Artificial Sequence
  Marburg virus siRNA sense strand
ggaaauuuaaaauuucaggca

SEQ ID NO: 32516 - RNA, 21 nt, Artificial Sequence
  Marburg virus siRNA sense strand
gaaauuuaaaauuucaggcaa

SEQ ID NO: 32517 - RNA, 21 nt, Artificial Sequence
  Marburg virus siRNA sense strand
aaauuuaaaauuucaggcaau

SEQ ID NO: 32518 - RNA, 21 nt, Artificial Sequence
  Marburg virus siRNA sense strand
aauuuaaaauuucaggcaaua

SEQ ID NO: 32519 - RNA, 21 nt, Artificial Sequence
  Marburg virus siRNA sense strand
auuuaaaauuucaggcaauaa

SEQ ID NO: 32520 - RNA, 21 nt, Artificial Sequence
  Marburg virus siRNA sense strand
uuuaaaauuucaggcaauaaa

SEQ ID NO: 32521 - RNA, 21 nt, Artificial Sequence
  Marburg virus siRNA sense strand
uuaaaauuucaggcaauaaag

SEQ ID NO: 32522 - RNA, 21 nt, Artificial Sequence
  Marburg virus siRNA sense strand
uaaaauuucaggcaauaaagc

SEQ ID NO: 32523 - RNA, 21 nt, Artificial Sequence
  Marburg virus siRNA sense strand
aaaauuucaggcaauaaagcu

SEQ ID NO: 32524 - RNA, 21 nt, Artificial Sequence
  Marburg virus siRNA sense strand
aaauuucaggcaauaaagcug

SEQ ID NO: 32525 - RNA, 21 nt, Artificial Sequence
  Marburg virus siRNA sense strand
aauuucaggcaauaaagcuga

SEQ ID NO: 32526 - RNA, 21 nt, Artificial Sequence
  Marburg virus siRNA sense strand
auuucaggcaauaaagcugag

SEQ ID NO: 32527 - RNA, 21 nt, Artificial Sequence
  Marburg virus siRNA sense strand
uuucaggcaauaaagcugagu

SEQ ID NO: 32528 - RNA, 21 nt, Artificial Sequence
  Marburg virus siRNA sense strand
uucaggcaauaaagcugagug

SEQ ID NO: 32529 - RNA, 21 nt, Artificial Sequence
  Marburg virus siRNA sense strand
ucaggcaauaaagcugagugu

SEQ ID NO: 32530 - RNA, 21 nt, Artificial Sequence
  Marburg virus siRNA sense strand
caggcaauaaagcugagugug

SEQ ID NO: 32531 - RNA, 21 nt, Artificial Sequence
  Marburg virus siRNA sense strand
aggcaauaaagcugagugugc

SEQ ID NO: 32532 - RNA, 21 nt, Artificial Sequence
  Marburg virus siRNA sense strand
ggcaauaaagcugagugugcu

SEQ ID NO: 32533 - RNA, 21 nt, Artificial Sequence
  Marburg virus siRNA sense strand
gcaauaaagcugagugugcuc

SEQ ID NO: 32534 - RNA, 21 nt, Artificial Sequence
  Marburg virus siRNA sense strand
caauaaagcugagugugcuca

SEQ ID NO: 32535 - RNA, 21 nt, Artificial Sequence
  Marburg virus siRNA sense strand
aauaaagcugagugugcucaa

SEQ ID NO: 32536 - RNA, 21 nt, Artificial Sequence
  Marburg virus siRNA sense strand
auaaagcugagugugcucaaa

SEQ ID NO: 32537 - RNA, 21 nt, Artificial Sequence
  Marburg virus siRNA sense strand
uaaagcugagugugcucaaaa

SEQ ID NO: 32538 - RNA, 21 nt, Artificial Sequence
  Marburg virus siRNA sense strand
aaagcugagugugcucaaaac

SEQ ID NO: 32539 - RNA, 21 nt, Artificial Sequence
  Marburg virus siRNA sense strand
aagcugagugugcucaaaacu

SEQ ID NO: 32540 - RNA, 21 nt, Artificial Sequence
  Marburg virus siRNA sense strand
agcugagugugcucaaaacuu

SEQ ID NO: 32541 - RNA, 21 nt, Artificial Sequence
  Marburg virus siRNA sense strand
gcugagugugcucaaaacuuu

SEQ ID NO: 32542 - RNA, 21 nt, Artificial Sequence
  Marburg virus siRNA sense strand
cugagugugcucaaaacuuua

SEQ ID NO: 32543 - RNA, 21 nt, Artificial Sequence
  Marburg virus siRNA sense strand
ugagugugcucaaaacuuuau

SEQ ID NO: 32544 - RNA, 21 nt, Artificial Sequence
  Marburg virus siRNA sense strand
gagugugcucaaaacuuuauu

SEQ ID NO: 32545 - RNA, 21 nt, Artificial Sequence
  Marburg virus siRNA sense strand
agugugcucaaaacuuuauua

SEQ ID NO: 32546 - RNA, 21 nt, Artificial Sequence
  Marburg virus siRNA sense strand
gugugcucaaaacuuuauuaa

SEQ ID NO: 32547 - RNA, 21 nt, Artificial Sequence
  Marburg virus siRNA sense strand
ugugcucaaaacuuuauuaaa

SEQ ID NO: 32548 - RNA, 21 nt, Artificial Sequence
  Marburg virus siRNA sense strand
gugcucaaaacuuuauuaaaa

SEQ ID NO: 32549 - RNA, 21 nt, Artificial Sequence
  Marburg virus siRNA sense strand
ugcucaaaacuuuauuaaaac

SEQ ID NO: 32550 - RNA, 21 nt, Artificial Sequence
  Marburg virus siRNA sense strand
gcucaaaacuuuauuaaaacu

SEQ ID NO: 32551 - RNA, 21 nt, Artificial Sequence
  Marburg virus siRNA sense strand
cucaaaacuuuauuaaaacua

SEQ ID NO: 32552 - RNA, 21 nt, Artificial Sequence
  Marburg virus siRNA sense strand
ucaaaacuuuauuaaaacuau

SEQ ID NO: 32553 - RNA, 21 nt, Artificial Sequence
  Marburg virus siRNA sense strand
caaaacuuuauuaaaacuaua

SEQ ID NO: 32554 - RNA, 21 nt, Artificial Sequence
  Marburg virus siRNA sense strand
aaaacuuuauuaaaacuauaa

SEQ ID NO: 32555 - RNA, 21 nt, Artificial Sequence
  Marburg virus siRNA sense strand
aaacuuuauuaaaacuauaau

SEQ ID NO: 32556 - RNA, 21 nt, Artificial Sequence
  Marburg virus siRNA sense strand
aacuuuauuaaaacuauaauu

SEQ ID NO: 32557 - RNA, 21 nt, Artificial Sequence
  Marburg virus siRNA sense strand
acuuuauuaaaacuauaauuc

SEQ ID NO: 32558 - RNA, 21 nt, Artificial Sequence
  Marburg virus siRNA sense strand
cuuuauuaaaacuauaauuca

SEQ ID NO: 32559 - RNA, 21 nt, Artificial Sequence
  Marburg virus siRNA sense strand
uuuauuaaaacuauaauucag

SEQ ID NO: 32560 - RNA, 21 nt, Artificial Sequence
  Marburg virus siRNA sense strand
uuauuaaaacuauaauucagg

SEQ ID NO: 32561 - RNA, 21 nt, Artificial Sequence
  Marburg virus siRNA sense strand
uauuaaaacuauaauucaggg

SEQ ID NO: 32562 - RNA, 21 nt, Artificial Sequence
  Marburg virus siRNA sense strand
auuaaaacuauaauucagggg

SEQ ID NO: 32563 - RNA, 21 nt, Artificial Sequence
  Marburg virus siRNA sense strand
uuaaaacuauaauucagggga

SEQ ID NO: 32564 - RNA, 21 nt, Artificial Sequence
  Marburg virus siRNA sense strand
uaaaacuauaauucaggggaa

SEQ ID NO: 32565 - RNA, 21 nt, Artificial Sequence
  Marburg virus siRNA sense strand
aaaacuauaauucaggggaaa

SEQ ID NO: 32566 - RNA, 21 nt, Artificial Sequence
  Marburg virus siRNA sense strand
aaacuauaauucaggggaaau

SEQ ID NO: 32567 - RNA, 21 nt, Artificial Sequence
  Marburg virus siRNA sense strand
aacuauaauucaggggaaauu

SEQ ID NO: 32568 - RNA, 21 nt, Artificial Sequence
  Marburg virus siRNA sense strand
acuauaauucaggggaaauug

SEQ ID NO: 32569 - RNA, 21 nt, Artificial Sequence
  Marburg virus siRNA sense strand
cuauaauucaggggaaauuga

SEQ ID NO: 32570 - RNA, 21 nt, Artificial Sequence
  Marburg virus siRNA sense strand
uauaauucaggggaaauugac

SEQ ID NO: 32571 - RNA, 21 nt, Artificial Sequence
  Marburg virus siRNA sense strand
auaauucaggggaaauugacu

SEQ ID NO: 32572 - RNA, 21 nt, Artificial Sequence
  Marburg virus siRNA sense strand
uaauucaggggaaauugacuc

SEQ ID NO: 32573 - RNA, 21 nt, Artificial Sequence
  Marburg virus siRNA sense strand
aauucaggggaaauugacucc

SEQ ID NO: 32574 - RNA, 21 nt, Artificial Sequence
  Marburg virus siRNA sense strand
auucaggggaaauugacuccu

SEQ ID NO: 32575 - RNA, 21 nt, Artificial Sequence
  Marburg virus siRNA sense strand
uucaggggaaauugacuccuc

SEQ ID NO: 32576 - RNA, 21 nt, Artificial Sequence
  Marburg virus siRNA sense strand
ucaggggaaauugacuccuca

SEQ ID NO: 32577 - RNA, 21 nt, Artificial Sequence
  Marburg virus siRNA sense strand
caggggaaauugacuccucaa

SEQ ID NO: 32578 - RNA, 21 nt, Artificial Sequence
  Marburg virus siRNA sense strand
aggggaaauugacuccucaac

SEQ ID NO: 32579 - RNA, 21 nt, Artificial Sequence
  Marburg virus siRNA sense strand
ggggaaauugacuccucaaca

SEQ ID NO: 32580 - RNA, 21 nt, Artificial Sequence
  Marburg virus siRNA sense strand
gggaaauugacuccucaacaa

SEQ ID NO: 32581 - RNA, 21 nt, Artificial Sequence
  Marburg virus siRNA sense strand
ggaaauugacuccucaacaau

SEQ ID NO: 32582 - RNA, 21 nt, Artificial Sequence
  Marburg virus siRNA sense strand
gaaauugacuccucaacaaua

SEQ ID NO: 32583 - RNA, 21 nt, Artificial Sequence
  Marburg virus siRNA sense strand
aaauugacuccucaacaauac

SEQ ID NO: 32584 - RNA, 21 nt, Artificial Sequence
  Marburg virus siRNA sense strand
aauugacuccucaacaauacu

SEQ ID NO: 32585 - RNA, 21 nt, Artificial Sequence
  Marburg virus siRNA sense strand
auugacuccucaacaauacug

SEQ ID NO: 32586 - RNA, 21 nt, Artificial Sequence
  Marburg virus siRNA sense strand
uugacuccucaacaauacugu

SEQ ID NO: 32587 - RNA, 21 nt, Artificial Sequence
  Marburg virus siRNA sense strand
ugacuccucaacaauacugug

SEQ ID NO: 32588 - RNA, 21 nt, Artificial Sequence
  Marburg virus siRNA sense strand
gacuccucaacaauacuguga

SEQ ID NO: 32589 - RNA, 21 nt, Artificial Sequence
  Marburg virus siRNA sense strand
acuccucaacaauacugugaa

SEQ ID NO: 32590 - RNA, 21 nt, Artificial Sequence
  Marburg virus siRNA sense strand
cuccucaacaauacugugaau

SEQ ID NO: 32591 - RNA, 21 nt, Artificial Sequence
  Marburg virus siRNA sense strand
uccucaacaauacugugaauu

SEQ ID NO: 32592 - RNA, 21 nt, Artificial Sequence
  Marburg virus siRNA sense strand
ccucaacaauacugugaauua

SEQ ID NO: 32593 - RNA, 21 nt, Artificial Sequence
  Marburg virus siRNA sense strand
cucaacaauacugugaauuau

SEQ ID NO: 32594 - RNA, 21 nt, Artificial Sequence
  Marburg virus siRNA sense strand
ucaacaauacugugaauuauu

SEQ ID NO: 32595 - RNA, 21 nt, Artificial Sequence
  Marburg virus siRNA sense strand
caacaauacugugaauuauuc

SEQ ID NO: 32596 - RNA, 21 nt, Artificial Sequence
  Marburg virus siRNA sense strand
aacaauacugugaauuauucu

SEQ ID NO: 32597 - RNA, 21 nt, Artificial Sequence
  Marburg virus siRNA sense strand
acaauacugugaauuauucuc

SEQ ID NO: 32598 - RNA, 21 nt, Artificial Sequence
  Marburg virus siRNA sense strand
caauacugugaauuauucucu

SEQ ID NO: 32599 - RNA, 21 nt, Artificial Sequence
  Marburg virus siRNA sense strand
aauacugugaauuauucucuc

SEQ ID NO: 32600 - RNA, 21 nt, Artificial Sequence
  Marburg virus siRNA sense strand
auacugugaauuauucucucu

SEQ ID NO: 32601 - RNA, 21 nt, Artificial Sequence
  Marburg virus siRNA sense strand
uacugugaauuauucucucua

SEQ ID NO: 32602 - RNA, 21 nt, Artificial Sequence
  Marburg virus siRNA sense strand
acugugaauuauucucucuac

SEQ ID NO: 32603 - RNA, 21 nt, Artificial Sequence
  Marburg virus siRNA sense strand
cugugaauuauucucucuaca

SEQ ID NO: 32604 - RNA, 21 nt, Artificial Sequence
  Marburg virus siRNA sense strand
ugugaauuauucucucuacaa

SEQ ID NO: 32605 - RNA, 21 nt, Artificial Sequence
  Marburg virus siRNA sense strand
gugaauuauucucucuacaaa

SEQ ID NO: 32606 - RNA, 21 nt, Artificial Sequence
  Marburg virus siRNA sense strand
ugaauuauucucucuacaaaa

SEQ ID NO: 32607 - RNA, 21 nt, Artificial Sequence
  Marburg virus siRNA sense strand
gaauuauucucucuacaaaag

SEQ ID NO: 32608 - RNA, 21 nt, Artificial Sequence
  Marburg virus siRNA sense strand
aauuauucucucuacaaaagc

SEQ ID NO: 32609 - RNA, 21 nt, Artificial Sequence
  Marburg virus siRNA sense strand
auuauucucucuacaaaagca

SEQ ID NO: 32610 - RNA, 21 nt, Artificial Sequence
  Marburg virus siRNA sense strand
uuauucucucuacaaaagcau

SEQ ID NO: 32611 - RNA, 21 nt, Artificial Sequence
  Marburg virus siRNA sense strand
uauucucucuacaaaagcauu

SEQ ID NO: 32612 - RNA, 21 nt, Artificial Sequence
  Marburg virus siRNA sense strand
auucucucuacaaaagcauug

SEQ ID NO: 32613 - RNA, 21 nt, Artificial Sequence
  Marburg virus siRNA sense strand
uucucucuacaaaagcauugg

SEQ ID NO: 32614 - RNA, 21 nt, Artificial Sequence
  Marburg virus siRNA sense strand
ucucucuacaaaagcauuggg

SEQ ID NO: 32615 - RNA, 21 nt, Artificial Sequence
  Marburg virus siRNA sense strand
cucucuacaaaagcauugggg

SEQ ID NO: 32616 - RNA, 21 nt, Artificial Sequence
  Marburg virus siRNA sense strand
ucucuacaaaagcauuggggu

SEQ ID NO: 32617 - RNA, 21 nt, Artificial Sequence
  Marburg virus siRNA sense strand
cucuacaaaagcauugggguc

SEQ ID NO: 32618 - RNA, 21 nt, Artificial Sequence
  Marburg virus siRNA sense strand
ucuacaaaagcauugggguca

SEQ ID NO: 32619 - RNA, 21 nt, Artificial Sequence
  Marburg virus siRNA sense strand
cuacaaaagcauuggggucac

SEQ ID NO: 32620 - RNA, 21 nt, Artificial Sequence
  Marburg virus siRNA sense strand
uacaaaagcauuggggucacc

SEQ ID NO: 32621 - RNA, 21 nt, Artificial Sequence
  Marburg virus siRNA sense strand
acaaaagcauuggggucaccc

SEQ ID NO: 32622 - RNA, 21 nt, Artificial Sequence
  Marburg virus siRNA sense strand
caaaagcauuggggucacccc

SEQ ID NO: 32623 - RNA, 21 nt, Artificial Sequence
  Marburg virus siRNA sense strand
aaaagcauuggggucaccccg

SEQ ID NO: 32624 - RNA, 21 nt, Artificial Sequence
  Marburg virus siRNA sense strand
aaagcauuggggucaccccgu

SEQ ID NO: 32625 - RNA, 21 nt, Artificial Sequence
  Marburg virus siRNA sense strand
aagcauuggggucaccccguu

SEQ ID NO: 32626 - RNA, 21 nt, Artificial Sequence
  Marburg virus siRNA sense strand
agcauuggggucaccccguuu

SEQ ID NO: 32627 - RNA, 21 nt, Artificial Sequence
  Marburg virus siRNA sense strand
gcauuggggucaccccguuuu

SEQ ID NO: 32628 - RNA, 21 nt, Artificial Sequence
  Marburg virus siRNA sense strand
cauuggggucaccccguuuua

SEQ ID NO: 32629 - RNA, 21 nt, Artificial Sequence
  Marburg virus siRNA sense strand
auuggggucaccccguuuuau

SEQ ID NO: 32630 - RNA, 21 nt, Artificial Sequence
  Marburg virus siRNA sense strand
uuggggucaccccguuuuaua

SEQ ID NO: 32631 - RNA, 21 nt, Artificial Sequence
  Marburg virus siRNA sense strand
uggggucaccccguuuuauac

SEQ ID NO: 32632 - RNA, 21 nt, Artificial Sequence
  Marburg virus siRNA sense strand
ggggucaccccguuuuauaca

SEQ ID NO: 32633 - RNA, 21 nt, Artificial Sequence
  Marburg virus siRNA sense strand
gggucaccccguuuuauacau

SEQ ID NO: 32634 - RNA, 21 nt, Artificial Sequence
  Marburg virus siRNA sense strand
ggucaccccguuuuauacauu

SEQ ID NO: 32635 - RNA, 21 nt, Artificial Sequence
  Marburg virus siRNA sense strand
gucaccccguuuuauacauug

SEQ ID NO: 32636 - RNA, 21 nt, Artificial Sequence
  Marburg virus siRNA sense strand
ucaccccguuuuauacauuga

SEQ ID NO: 32637 - RNA, 21 nt, Artificial Sequence
  Marburg virus siRNA sense strand
caccccguuuuauacauugau

SEQ ID NO: 32638 - RNA, 21 nt, Artificial Sequence
  Marburg virus siRNA sense strand
accccguuuuauacauugaug

SEQ ID NO: 32639 - RNA, 21 nt, Artificial Sequence
  Marburg virus siRNA sense strand
ccccguuuuauacauugaugu

SEQ ID NO: 32640 - RNA, 21 nt, Artificial Sequence
  Marburg virus siRNA sense strand
cccguuuuauacauugauguu

SEQ ID NO: 32641 - RNA, 21 nt, Artificial Sequence
  Marburg virus siRNA sense strand
ccguuuuauacauugauguug

SEQ ID NO: 32642 - RNA, 21 nt, Artificial Sequence
  Marburg virus siRNA sense strand
cguuuuauacauugauguugc

SEQ ID NO: 32643 - RNA, 21 nt, Artificial Sequence
  Marburg virus siRNA sense strand
guuuuauacauugauguugca

SEQ ID NO: 32644 - RNA, 21 nt, Artificial Sequence
  Marburg virus siRNA sense strand
uuuuauacauugauguugcac

SEQ ID NO: 32645 - RNA, 21 nt, Artificial Sequence
  Marburg virus siRNA sense strand
uuuauacauugauguugcacu

SEQ ID NO: 32646 - RNA, 21 nt, Artificial Sequence
  Marburg virus siRNA sense strand
uuauacauugauguugcacua

SEQ ID NO: 32647 - RNA, 21 nt, Artificial Sequence
  Marburg virus siRNA sense strand
uauacauugauguugcacuag

SEQ ID NO: 32648 - RNA, 21 nt, Artificial Sequence
  Marburg virus siRNA sense strand
auacauugauguugcacuaga

SEQ ID NO: 32649 - RNA, 21 nt, Artificial Sequence
  Marburg virus siRNA sense strand
uacauugauguugcacuagau

SEQ ID NO: 32650 - RNA, 21 nt, Artificial Sequence
  Marburg virus siRNA sense strand
acauugauguugcacuagaua

SEQ ID NO: 32651 - RNA, 21 nt, Artificial Sequence
  Marburg virus siRNA sense strand
cauugauguugcacuagauaa

SEQ ID NO: 32652 - RNA, 21 nt, Artificial Sequence
  Marburg virus siRNA sense strand
auugauguugcacuagauaag

SEQ ID NO: 32653 - RNA, 21 nt, Artificial Sequence
  Marburg virus siRNA sense strand
uugauguugcacuagauaagg

SEQ ID NO: 32654 - RNA, 21 nt, Artificial Sequence
  Marburg virus siRNA sense strand
ugauguugcacuagauaaggu

SEQ ID NO: 32655 - RNA, 21 nt, Artificial Sequence
  Marburg virus siRNA sense strand
gauguugcacuagauaagguu

SEQ ID NO: 32656 - RNA, 21 nt, Artificial Sequence
  Marburg virus siRNA sense strand
auguugcacuagauaagguua

SEQ ID NO: 32657 - RNA, 21 nt, Artificial Sequence
  Marburg virus siRNA sense strand
uguugcacuagauaagguuaa

SEQ ID NO: 32658 - RNA, 21 nt, Artificial Sequence
  Marburg virus siRNA sense strand
guugcacuagauaagguuaaa

SEQ ID NO: 32659 - RNA, 21 nt, Artificial Sequence
  Marburg virus siRNA sense strand
uugcacuagauaagguuaaaa

SEQ ID NO: 32660 - RNA, 21 nt, Artificial Sequence
  Marburg virus siRNA sense strand
ugcacuagauaagguuaaaaa

SEQ ID NO: 32661 - RNA, 21 nt, Artificial Sequence
  Marburg virus siRNA sense strand
gcacuagauaagguuaaaaaa

SEQ ID NO: 32662 - RNA, 21 nt, Artificial Sequence
  Marburg virus siRNA sense strand
cacuagauaagguuaaaaaac

SEQ ID NO: 32663 - RNA, 21 nt, Artificial Sequence
  Marburg virus siRNA sense strand
acuagauaagguuaaaaaaca

SEQ ID NO: 32664 - RNA, 21 nt, Artificial Sequence
  Marburg virus siRNA sense strand
cuagauaagguuaaaaaacau

SEQ ID NO: 32665 - RNA, 21 nt, Artificial Sequence
  Marburg virus siRNA sense strand
uagauaagguuaaaaaacaug

SEQ ID NO: 32666 - RNA, 21 nt, Artificial Sequence
  Marburg virus siRNA sense strand
agauaagguuaaaaaacaugc

SEQ ID NO: 32667 - RNA, 21 nt, Artificial Sequence
  Marburg virus siRNA sense strand
gauaagguuaaaaaacaugcg

SEQ ID NO: 32668 - RNA, 21 nt, Artificial Sequence
  Marburg virus siRNA sense strand
auaagguuaaaaaacaugcgc

SEQ ID NO: 32669 - RNA, 21 nt, Artificial Sequence
  Marburg virus siRNA sense strand
uaagguuaaaaaacaugcgca

SEQ ID NO: 32670 - RNA, 21 nt, Artificial Sequence
  Marburg virus siRNA sense strand
aagguuaaaaaacaugcgcaa

SEQ ID NO: 32671 - RNA, 21 nt, Artificial Sequence
  Marburg virus siRNA sense strand
agguuaaaaaacaugcgcaau

SEQ ID NO: 32672 - RNA, 21 nt, Artificial Sequence
  Marburg virus siRNA sense strand
gguuaaaaaacaugcgcaauc

SEQ ID NO: 32673 - RNA, 21 nt, Artificial Sequence
  Marburg virus siRNA sense strand
guuaaaaaacaugcgcaaucu

SEQ ID NO: 32674 - RNA, 21 nt, Artificial Sequence
  Marburg virus siRNA sense strand
uuaaaaaacaugcgcaaucug

SEQ ID NO: 32675 - RNA, 21 nt, Artificial Sequence
  Marburg virus siRNA sense strand
uaaaaaacaugcgcaaucugu

SEQ ID NO: 32676 - RNA, 21 nt, Artificial Sequence
  Marburg virus siRNA sense strand
aaaaaacaugcgcaaucugua

SEQ ID NO: 32677 - RNA, 21 nt, Artificial Sequence
  Marburg virus siRNA sense strand
aaaaacaugcgcaaucuguaa

SEQ ID NO: 32678 - RNA, 21 nt, Artificial Sequence
  Marburg virus siRNA sense strand
aaaacaugcgcaaucuguaaa

SEQ ID NO: 32679 - RNA, 21 nt, Artificial Sequence
  Marburg virus siRNA sense strand
aaacaugcgcaaucuguaaaa

SEQ ID NO: 32680 - RNA, 21 nt, Artificial Sequence
  Marburg virus siRNA sense strand
aacaugcgcaaucuguaaaaa

SEQ ID NO: 32681 - RNA, 21 nt, Artificial Sequence
  Marburg virus siRNA sense strand
acaugcgcaaucuguaaaaau

SEQ ID NO: 32682 - RNA, 21 nt, Artificial Sequence
  Marburg virus siRNA sense strand
caugcgcaaucuguaaaaauc

SEQ ID NO: 32683 - RNA, 21 nt, Artificial Sequence
  Marburg virus siRNA sense strand
augcgcaaucuguaaaaaucu

SEQ ID NO: 32684 - RNA, 21 nt, Artificial Sequence
  Marburg virus siRNA sense strand
ugcgcaaucuguaaaaaucuu

SEQ ID NO: 32685 - RNA, 21 nt, Artificial Sequence
  Marburg virus siRNA sense strand
gcgcaaucuguaaaaaucuua

SEQ ID NO: 32686 - RNA, 21 nt, Artificial Sequence
  Marburg virus siRNA sense strand
cgcaaucuguaaaaaucuuaa

SEQ ID NO: 32687 - RNA, 21 nt, Artificial Sequence
  Marburg virus siRNA sense strand
gcaaucuguaaaaaucuuaaa

SEQ ID NO: 32688 - RNA, 21 nt, Artificial Sequence
  Marburg virus siRNA sense strand
caaucuguaaaaaucuuaaaa

SEQ ID NO: 32689 - RNA, 21 nt, Artificial Sequence
  Marburg virus siRNA sense strand
aaucuguaaaaaucuuaaaac

SEQ ID NO: 32690 - RNA, 21 nt, Artificial Sequence
  Marburg virus siRNA sense strand
aucuguaaaaaucuuaaaacc

SEQ ID NO: 32691 - RNA, 21 nt, Artificial Sequence
  Marburg virus siRNA sense strand
ucuguaaaaaucuuaaaaccu

SEQ ID NO: 32692 - RNA, 21 nt, Artificial Sequence
  Marburg virus siRNA sense strand
cuguaaaaaucuuaaaaccua

SEQ ID NO: 32693 - RNA, 21 nt, Artificial Sequence
  Marburg virus siRNA sense strand
uguaaaaaucuuaaaaccuaa

SEQ ID NO: 32694 - RNA, 21 nt, Artificial Sequence
  Marburg virus siRNA sense strand
guaaaaaucuuaaaaccuaaa

SEQ ID NO: 32695 - RNA, 21 nt, Artificial Sequence
  Marburg virus siRNA sense strand
uaaaaaucuuaaaaccuaaag

SEQ ID NO: 32696 - RNA, 21 nt, Artificial Sequence
  Marburg virus siRNA sense strand
aaaaaucuuaaaaccuaaagu

SEQ ID NO: 32697 - RNA, 21 nt, Artificial Sequence
  Marburg virus siRNA sense strand
aaaaucuuaaaaccuaaaguc

SEQ ID NO: 32698 - RNA, 21 nt, Artificial Sequence
  Marburg virus siRNA sense strand
aaaucuuaaaaccuaaaguca

SEQ ID NO: 32699 - RNA, 21 nt, Artificial Sequence
  Marburg virus siRNA sense strand
aaucuuaaaaccuaaagucau

SEQ ID NO: 32700 - RNA, 21 nt, Artificial Sequence
  Marburg virus siRNA sense strand
aucuuaaaaccuaaagucaug

SEQ ID NO: 32701 - RNA, 21 nt, Artificial Sequence
  Marburg virus siRNA sense strand
ucuuaaaaccuaaagucaugu

SEQ ID NO: 32702 - RNA, 21 nt, Artificial Sequence
  Marburg virus siRNA sense strand
cuuaaaaccuaaagucauguu

SEQ ID NO: 32703 - RNA, 21 nt, Artificial Sequence
  Marburg virus siRNA sense strand
uuaaaaccuaaagucauguuu

SEQ ID NO: 32704 - RNA, 21 nt, Artificial Sequence
  Marburg virus siRNA sense strand
uaaaaccuaaagucauguuug

SEQ ID NO: 32705 - RNA, 21 nt, Artificial Sequence
  Marburg virus siRNA sense strand
aaaaccuaaagucauguuuga

SEQ ID NO: 32706 - RNA, 21 nt, Artificial Sequence
  Marburg virus siRNA sense strand
aaaccuaaagucauguuugaa

SEQ ID NO: 32707 - RNA, 21 nt, Artificial Sequence
  Marburg virus siRNA sense strand
aaccuaaagucauguuugaaa

SEQ ID NO: 32708 - RNA, 21 nt, Artificial Sequence
  Marburg virus siRNA sense strand
accuaaagucauguuugaaac

SEQ ID NO: 32709 - RNA, 21 nt, Artificial Sequence
  Marburg virus siRNA sense strand
ccuaaagucauguuugaaacu

SEQ ID NO: 32710 - RNA, 21 nt, Artificial Sequence
  Marburg virus siRNA sense strand
cuaaagucauguuugaaacuu

SEQ ID NO: 32711 - RNA, 21 nt, Artificial Sequence
  Marburg virus siRNA sense strand
uaaagucauguuugaaacuuu

SEQ ID NO: 32712 - RNA, 21 nt, Artificial Sequence
  Marburg virus siRNA sense strand
aaagucauguuugaaacuuuu

SEQ ID NO: 32713 - RNA, 21 nt, Artificial Sequence
  Marburg virus siRNA sense strand
aagucauguuugaaacuuuuu

SEQ ID NO: 32714 - RNA, 21 nt, Artificial Sequence
  Marburg virus siRNA sense strand
agucauguuugaaacuuuuug

SEQ ID NO: 32715 - RNA, 21 nt, Artificial Sequence
  Marburg virus siRNA sense strand
gucauguuugaaacuuuuugu

SEQ ID NO: 32716 - RNA, 21 nt, Artificial Sequence
  Marburg virus siRNA sense strand
ucauguuugaaacuuuuugug

SEQ ID NO: 32717 - RNA, 21 nt, Artificial Sequence
  Marburg virus siRNA sense strand
cauguuugaaacuuuuugugu

SEQ ID NO: 32718 - RNA, 21 nt, Artificial Sequence
  Marburg virus siRNA sense strand
auguuugaaacuuuuuguguu

SEQ ID NO: 32719 - RNA, 21 nt, Artificial Sequence
  Marburg virus siRNA sense strand
uguuugaaacuuuuuguguuu

SEQ ID NO: 32720 - RNA, 21 nt, Artificial Sequence
  Marburg virus siRNA sense strand
guuugaaacuuuuuguguuuu

SEQ ID NO: 32721 - RNA, 21 nt, Artificial Sequence
  Marburg virus siRNA sense strand
uuugaaacuuuuuguguuuuc

SEQ ID NO: 32722 - RNA, 21 nt, Artificial Sequence
  Marburg virus siRNA sense strand
uugaaacuuuuuguguuuuca

SEQ ID NO: 32723 - RNA, 21 nt, Artificial Sequence
  Marburg virus siRNA sense strand
ugaaacuuuuuguguuuucaa

SEQ ID NO: 32724 - RNA, 21 nt, Artificial Sequence
  Marburg virus siRNA sense strand
gaaacuuuuuguguuuucaaa

SEQ ID NO: 32725 - RNA, 21 nt, Artificial Sequence
  Marburg virus siRNA sense strand
aaacuuuuuguguuuucaaau

SEQ ID NO: 32726 - RNA, 21 nt, Artificial Sequence
  Marburg virus siRNA sense strand
aacuuuuuguguuuucaaauu

SEQ ID NO: 32727 - RNA, 21 nt, Artificial Sequence
  Marburg virus siRNA sense strand
acuuuuuguguuuucaaauuu

SEQ ID NO: 32728 - RNA, 21 nt, Artificial Sequence
  Marburg virus siRNA sense strand
cuuuuuguguuuucaaauuua

SEQ ID NO: 32729 - RNA, 21 nt, Artificial Sequence
  Marburg virus siRNA sense strand
uuuuuguguuuucaaauuuau

SEQ ID NO: 32730 - RNA, 21 nt, Artificial Sequence
  Marburg virus siRNA sense strand
uuuuguguuuucaaauuuaua

SEQ ID NO: 32731 - RNA, 21 nt, Artificial Sequence
  Marburg virus siRNA sense strand
uuuguguuuucaaauuuauag

SEQ ID NO: 32732 - RNA, 21 nt, Artificial Sequence
  Marburg virus siRNA sense strand
uuguguuuucaaauuuauagu

SEQ ID NO: 32733 - RNA, 21 nt, Artificial Sequence
  Marburg virus siRNA sense strand
uguguuuucaaauuuauagua

SEQ ID NO: 32734 - RNA, 21 nt, Artificial Sequence
  Marburg virus siRNA sense strand
guguuuucaaauuuauaguag

SEQ ID NO: 32735 - RNA, 21 nt, Artificial Sequence
  Marburg virus siRNA sense strand
uguuuucaaauuuauaguagc

SEQ ID NO: 32736 - RNA, 21 nt, Artificial Sequence
  Marburg virus siRNA sense strand
guuuucaaauuuauaguagca

SEQ ID NO: 32737 - RNA, 21 nt, Artificial Sequence
  Marburg virus siRNA sense strand
uuuucaaauuuauaguagcaa

SEQ ID NO: 32738 - RNA, 21 nt, Artificial Sequence
  Marburg virus siRNA sense strand
uuucaaauuuauaguagcaaa

SEQ ID NO: 32739 - RNA, 21 nt, Artificial Sequence
  Marburg virus siRNA sense strand
uucaaauuuauaguagcaaag

SEQ ID NO: 32740 - RNA, 21 nt, Artificial Sequence
  Marburg virus siRNA sense strand
ucaaauuuauaguagcaaaga

SEQ ID NO: 32741 - RNA, 21 nt, Artificial Sequence
  Marburg virus siRNA sense strand
caaauuuauaguagcaaagaa

SEQ ID NO: 32742 - RNA, 21 nt, Artificial Sequence
  Marburg virus siRNA sense strand
aaauuuauaguagcaaagaau

SEQ ID NO: 32743 - RNA, 21 nt, Artificial Sequence
  Marburg virus siRNA sense strand
aauuuauaguagcaaagaauc

SEQ ID NO: 32744 - RNA, 21 nt, Artificial Sequence
  Marburg virus siRNA sense strand
auuuauaguagcaaagaauca

SEQ ID NO: 32745 - RNA, 21 nt, Artificial Sequence
  Marburg virus siRNA sense strand
uuuauaguagcaaagaaucau

SEQ ID NO: 32746 - RNA, 21 nt, Artificial Sequence
  Marburg virus siRNA sense strand
uuauaguagcaaagaaucauu

SEQ ID NO: 32747 - RNA, 21 nt, Artificial Sequence
  Marburg virus siRNA sense strand
uauaguagcaaagaaucauua

SEQ ID NO: 32748 - RNA, 21 nt, Artificial Sequence
  Marburg virus siRNA sense strand
auaguagcaaagaaucauuau

SEQ ID NO: 32749 - RNA, 21 nt, Artificial Sequence
  Marburg virus siRNA sense strand
uaguagcaaagaaucauuauc

SEQ ID NO: 32750 - RNA, 21 nt, Artificial Sequence
  Marburg virus siRNA sense strand
aguagcaaagaaucauuauca

SEQ ID NO: 32751 - RNA, 21 nt, Artificial Sequence
  Marburg virus siRNA sense strand
guagcaaagaaucauuaucau

SEQ ID NO: 32752 - RNA, 21 nt, Artificial Sequence
  Marburg virus siRNA sense strand
uagcaaagaaucauuaucauu

SEQ ID NO: 32753 - RNA, 21 nt, Artificial Sequence
  Marburg virus siRNA sense strand
agcaaagaaucauuaucauuc

SEQ ID NO: 32754 - RNA, 21 nt, Artificial Sequence
  Marburg virus siRNA sense strand
gcaaagaaucauuaucauucu

SEQ ID NO: 32755 - RNA, 21 nt, Artificial Sequence
  Marburg virus siRNA sense strand
caaagaaucauuaucauucuc

SEQ ID NO: 32756 - RNA, 21 nt, Artificial Sequence
  Marburg virus siRNA sense strand
aaagaaucauuaucauucuca

SEQ ID NO: 32757 - RNA, 21 nt, Artificial Sequence
  Marburg virus siRNA sense strand
aagaaucauuaucauucucaa

SEQ ID NO: 32758 - RNA, 21 nt, Artificial Sequence
  Marburg virus siRNA sense strand
agaaucauuaucauucucaag

SEQ ID NO: 32759 - RNA, 21 nt, Artificial Sequence
  Marburg virus siRNA sense strand
gaaucauuaucauucucaagg

SEQ ID NO: 32760 - RNA, 21 nt, Artificial Sequence
  Marburg virus siRNA sense strand
aaucauuaucauucucaagga

SEQ ID NO: 32761 - RNA, 21 nt, Artificial Sequence
  Marburg virus siRNA sense strand
aucauuaucauucucaaggau

SEQ ID NO: 32762 - RNA, 21 nt, Artificial Sequence
  Marburg virus siRNA sense strand
ucauuaucauucucaaggauc

SEQ ID NO: 32763 - RNA, 21 nt, Artificial Sequence
  Marburg virus siRNA sense strand
cauuaucauucucaaggauca

SEQ ID NO: 32764 - RNA, 21 nt, Artificial Sequence
  Marburg virus siRNA sense strand
auuaucauucucaaggaucau

SEQ ID NO: 32765 - RNA, 21 nt, Artificial Sequence
  Marburg virus siRNA sense strand
uuaucauucucaaggaucaug

SEQ ID NO: 32766 - RNA, 21 nt, Artificial Sequence
  Marburg virus siRNA sense strand
uaucauucucaaggaucaugg

SEQ ID NO: 32767 - RNA, 21 nt, Artificial Sequence
  Marburg virus siRNA sense strand
aucauucucaaggaucauggu

SEQ ID NO: 32768 - RNA, 21 nt, Artificial Sequence
  Marburg virus siRNA sense strand
ucauucucaaggaucauggua

SEQ ID NO: 32769 - RNA, 21 nt, Artificial Sequence
  Marburg virus siRNA sense strand
cauucucaaggaucaugguau

SEQ ID NO: 32770 - RNA, 21 nt, Artificial Sequence
  Marburg virus siRNA sense strand
auucucaaggaucaugguaua

SEQ ID NO: 32771 - RNA, 21 nt, Artificial Sequence
  Marburg virus siRNA sense strand
uucucaaggaucaugguauaa

SEQ ID NO: 32772 - RNA, 21 nt, Artificial Sequence
  Marburg virus siRNA sense strand
ucucaaggaucaugguauaaa

SEQ ID NO: 32773 - RNA, 21 nt, Artificial Sequence
  Marburg virus siRNA sense strand
cucaaggaucaugguauaaaa

SEQ ID NO: 32774 - RNA, 21 nt, Artificial Sequence
  Marburg virus siRNA sense strand
ucaaggaucaugguauaaaac

SEQ ID NO: 32775 - RNA, 21 nt, Artificial Sequence
  Marburg virus siRNA sense strand
caaggaucaugguauaaaacc

SEQ ID NO: 32776 - RNA, 21 nt, Artificial Sequence
  Marburg virus siRNA sense strand
aaggaucaugguauaaaacca

SEQ ID NO: 32777 - RNA, 21 nt, Artificial Sequence
  Marburg virus siRNA sense strand
aggaucaugguauaaaaccac

SEQ ID NO: 32778 - RNA, 21 nt, Artificial Sequence
  Marburg virus siRNA sense strand
ggaucaugguauaaaaccaca

SEQ ID NO: 32779 - RNA, 21 nt, Artificial Sequence
  Marburg virus siRNA sense strand
gaucaugguauaaaaccacaa

SEQ ID NO: 32780 - RNA, 21 nt, Artificial Sequence
  Marburg virus siRNA sense strand
aucaugguauaaaaccacaau

SEQ ID NO: 32781 - RNA, 21 nt, Artificial Sequence
  Marburg virus siRNA sense strand
ucaugguauaaaaccacaaug

SEQ ID NO: 32782 - RNA, 21 nt, Artificial Sequence
  Marburg virus siRNA sense strand
caugguauaaaaccacaaugg

SEQ ID NO: 32783 - RNA, 21 nt, Artificial Sequence
  Marburg virus siRNA sense strand
augguauaaaaccacaaugga

SEQ ID NO: 32784 - RNA, 21 nt, Artificial Sequence
  Marburg virus siRNA sense strand
ugguauaaaaccacaauggau

SEQ ID NO: 32785 - RNA, 21 nt, Artificial Sequence
  Marburg virus siRNA sense strand
gguauaaaaccacaauggauu

SEQ ID NO: 32786 - RNA, 21 nt, Artificial Sequence
  Marburg virus siRNA sense strand
guauaaaaccacaauggauuu

SEQ ID NO: 32787 - RNA, 21 nt, Artificial Sequence
  Marburg virus siRNA sense strand
uauaaaaccacaauggauuug

SEQ ID NO: 32788 - RNA, 21 nt, Artificial Sequence
  Marburg virus siRNA sense strand
auaaaaccacaauggauuugc

SEQ ID NO: 32789 - RNA, 21 nt, Artificial Sequence
  Marburg virus siRNA sense strand
uaaaaccacaauggauuugca

SEQ ID NO: 32790 - RNA, 21 nt, Artificial Sequence
  Marburg virus siRNA sense strand
aaaaccacaauggauuugcau

SEQ ID NO: 32791 - RNA, 21 nt, Artificial Sequence
  Marburg virus siRNA sense strand
aaaccacaauggauuugcauu

SEQ ID NO: 32792 - RNA, 21 nt, Artificial Sequence
  Marburg virus siRNA sense strand
aaccacaauggauuugcauuu

SEQ ID NO: 32793 - RNA, 21 nt, Artificial Sequence
  Marburg virus siRNA sense strand
accacaauggauuugcauuua

SEQ ID NO: 32794 - RNA, 21 nt, Artificial Sequence
  Marburg virus siRNA sense strand
ccacaauggauuugcauuuaa

SEQ ID NO: 32795 - RNA, 21 nt, Artificial Sequence
  Marburg virus siRNA sense strand
cacaauggauuugcauuuaac

SEQ ID NO: 32796 - RNA, 21 nt, Artificial Sequence
  Marburg virus siRNA sense strand
acaauggauuugcauuuaacu

SEQ ID NO: 32797 - RNA, 21 nt, Artificial Sequence
  Marburg virus siRNA sense strand
caauggauuugcauuuaacuc

SEQ ID NO: 32798 - RNA, 21 nt, Artificial Sequence
  Marburg virus siRNA sense strand
aauggauuugcauuuaacucc

SEQ ID NO: 32799 - RNA, 21 nt, Artificial Sequence
  Marburg virus siRNA sense strand
auggauuugcauuuaacucca

SEQ ID NO: 32800 - RNA, 21 nt, Artificial Sequence
  Marburg virus siRNA sense strand
uggauuugcauuuaacuccau

SEQ ID NO: 32801 - RNA, 21 nt, Artificial Sequence
  Marburg virus siRNA sense strand
ggauuugcauuuaacuccaua

SEQ ID NO: 32802 - RNA, 21 nt, Artificial Sequence
  Marburg virus siRNA sense strand
gauuugcauuuaacuccauau

SEQ ID NO: 32803 - RNA, 21 nt, Artificial Sequence
  Marburg virus siRNA sense strand
auuugcauuuaacuccauauc

SEQ ID NO: 32804 - RNA, 21 nt, Artificial Sequence
  Marburg virus siRNA sense strand
uuugcauuuaacuccauaucu

SEQ ID NO: 32805 - RNA, 21 nt, Artificial Sequence
  Marburg virus siRNA sense strand
uugcauuuaacuccauaucuu

SEQ ID NO: 32806 - RNA, 21 nt, Artificial Sequence
  Marburg virus siRNA sense strand
ugcauuuaacuccauaucuua

SEQ ID NO: 32807 - RNA, 21 nt, Artificial Sequence
  Marburg virus siRNA sense strand
gcauuuaacuccauaucuuag

SEQ ID NO: 32808 - RNA, 21 nt, Artificial Sequence
  Marburg virus siRNA sense strand
cauuuaacuccauaucuuaga

SEQ ID NO: 32809 - RNA, 21 nt, Artificial Sequence
  Marburg virus siRNA sense strand
auuuaacuccauaucuuagac

SEQ ID NO: 32810 - RNA, 21 nt, Artificial Sequence
  Marburg virus siRNA sense strand
uuuaacuccauaucuuagaca

SEQ ID NO: 32811 - RNA, 21 nt, Artificial Sequence
  Marburg virus siRNA sense strand
uuaacuccauaucuuagacaa

SEQ ID NO: 32812 - RNA, 21 nt, Artificial Sequence
  Marburg virus siRNA sense strand
uaacuccauaucuuagacaac

SEQ ID NO: 32813 - RNA, 21 nt, Artificial Sequence
  Marburg virus siRNA sense strand
aacuccauaucuuagacaaca

SEQ ID NO: 32814 - RNA, 21 nt, Artificial Sequence
  Marburg virus siRNA sense strand
acuccauaucuuagacaacau

SEQ ID NO: 32815 - RNA, 21 nt, Artificial Sequence
  Marburg virus siRNA sense strand
cuccauaucuuagacaacaua

SEQ ID NO: 32816 - RNA, 21 nt, Artificial Sequence
  Marburg virus siRNA sense strand
uccauaucuuagacaacauau

SEQ ID NO: 32817 - RNA, 21 nt, Artificial Sequence
  Marburg virus siRNA sense strand
ccauaucuuagacaacauauu

SEQ ID NO: 32818 - RNA, 21 nt, Artificial Sequence
  Marburg virus siRNA sense strand
cauaucuuagacaacauauug

SEQ ID NO: 32819 - RNA, 21 nt, Artificial Sequence
  Marburg virus siRNA sense strand
auaucuuagacaacauauugu

SEQ ID NO: 32820 - RNA, 21 nt, Artificial Sequence
  Marburg virus siRNA sense strand
uaucuuagacaacauauugug

SEQ ID NO: 32821 - RNA, 21 nt, Artificial Sequence
  Marburg virus siRNA sense strand
aucuuagacaacauauugugu

SEQ ID NO: 32822 - RNA, 21 nt, Artificial Sequence
  Marburg virus siRNA sense strand
ucuuagacaacauauuguguc

SEQ ID NO: 32823 - RNA, 21 nt, Artificial Sequence
  Marburg virus siRNA sense strand
cuuagacaacauauuguguca

SEQ ID NO: 32824 - RNA, 21 nt, Artificial Sequence
  Marburg virus siRNA sense strand
uuagacaacauauugugucaa

SEQ ID NO: 32825 - RNA, 21 nt, Artificial Sequence
  Marburg virus siRNA sense strand
uagacaacauauugugucaaa

SEQ ID NO: 32826 - RNA, 21 nt, Artificial Sequence
  Marburg virus siRNA sense strand
agacaacauauugugucaaau

SEQ ID NO: 32827 - RNA, 21 nt, Artificial Sequence
  Marburg virus siRNA sense strand
gacaacauauugugucaaauu

SEQ ID NO: 32828 - RNA, 21 nt, Artificial Sequence
  Marburg virus siRNA sense strand
acaacauauugugucaaauuc

SEQ ID NO: 32829 - RNA, 21 nt, Artificial Sequence
  Marburg virus siRNA sense strand
caacauauugugucaaauuca

SEQ ID NO: 32830 - RNA, 21 nt, Artificial Sequence
  Marburg virus siRNA sense strand
aacauauugugucaaauucau

SEQ ID NO: 32831 - RNA, 21 nt, Artificial Sequence
  Marburg virus siRNA sense strand
acauauugugucaaauucauu

SEQ ID NO: 32832 - RNA, 21 nt, Artificial Sequence
  Marburg virus siRNA sense strand
cauauugugucaaauucauuu

SEQ ID NO: 32833 - RNA, 21 nt, Artificial Sequence
  Marburg virus siRNA sense strand
auauugugucaaauucauuuc

SEQ ID NO: 32834 - RNA, 21 nt, Artificial Sequence
  Marburg virus siRNA sense strand
uauugugucaaauucauuucc

SEQ ID NO: 32835 - RNA, 21 nt, Artificial Sequence
  Marburg virus siRNA sense strand
auugugucaaauucauuuccg

SEQ ID NO: 32836 - RNA, 21 nt, Artificial Sequence
  Marburg virus siRNA sense strand
uugugucaaauucauuuccgu

SEQ ID NO: 32837 - RNA, 21 nt, Artificial Sequence
  Marburg virus siRNA sense strand
ugugucaaauucauuuccguc

SEQ ID NO: 32838 - RNA, 21 nt, Artificial Sequence
  Marburg virus siRNA sense strand
gugucaaauucauuuccguca

SEQ ID NO: 32839 - RNA, 21 nt, Artificial Sequence
  Marburg virus siRNA sense strand
ugucaaauucauuuccgucac

SEQ ID NO: 32840 - RNA, 21 nt, Artificial Sequence
  Marburg virus siRNA sense strand
gucaaauucauuuccgucaca

SEQ ID NO: 32841 - RNA, 21 nt, Artificial Sequence
  Marburg virus siRNA sense strand
ucaaauucauuuccgucacaa

SEQ ID NO: 32842 - RNA, 21 nt, Artificial Sequence
  Marburg virus siRNA sense strand
caaauucauuuccgucacaag

SEQ ID NO: 32843 - RNA, 21 nt, Artificial Sequence
  Marburg virus siRNA sense strand
aaauucauuuccgucacaagc

SEQ ID NO: 32844 - RNA, 21 nt, Artificial Sequence
  Marburg virus siRNA sense strand
aauucauuuccgucacaagcc

SEQ ID NO: 32845 - RNA, 21 nt, Artificial Sequence
  Marburg virus siRNA sense strand
auucauuuccgucacaagccg

SEQ ID NO: 32846 - RNA, 21 nt, Artificial Sequence
  Marburg virus siRNA sense strand
uucauuuccgucacaagccga

SEQ ID NO: 32847 - RNA, 21 nt, Artificial Sequence
  Marburg virus siRNA sense strand
ucauuuccgucacaagccgaa

SEQ ID NO: 32848 - RNA, 21 nt, Artificial Sequence
  Marburg virus siRNA sense strand
cauuuccgucacaagccgaaa

SEQ ID NO: 32849 - RNA, 21 nt, Artificial Sequence
  Marburg virus siRNA sense strand
auuuccgucacaagccgaaau

SEQ ID NO: 32850 - RNA, 21 nt, Artificial Sequence
  Marburg virus siRNA sense strand
uuuccgucacaagccgaaauu

SEQ ID NO: 32851 - RNA, 21 nt, Artificial Sequence
  Marburg virus siRNA sense strand
uuccgucacaagccgaaauuu

SEQ ID NO: 32852 - RNA, 21 nt, Artificial Sequence
  Marburg virus siRNA sense strand
uccgucacaagccgaaauuua

SEQ ID NO: 32853 - RNA, 21 nt, Artificial Sequence
  Marburg virus siRNA sense strand
ccgucacaagccgaaauuuau

SEQ ID NO: 32854 - RNA, 21 nt, Artificial Sequence
  Marburg virus siRNA sense strand
cgucacaagccgaaauuuauc

SEQ ID NO: 32855 - RNA, 21 nt, Artificial Sequence
  Marburg virus siRNA sense strand
gucacaagccgaaauuuauca

SEQ ID NO: 32856 - RNA, 21 nt, Artificial Sequence
  Marburg virus siRNA sense strand
ucacaagccgaaauuuaucag

SEQ ID NO: 32857 - RNA, 21 nt, Artificial Sequence
  Marburg virus siRNA sense strand
cacaagccgaaauuuaucagc

SEQ ID NO: 32858 - RNA, 21 nt, Artificial Sequence
  Marburg virus siRNA sense strand
acaagccgaaauuuaucagca

SEQ ID NO: 32859 - RNA, 21 nt, Artificial Sequence
  Marburg virus siRNA sense strand
caagccgaaauuuaucagcau

SEQ ID NO: 32860 - RNA, 21 nt, Artificial Sequence
  Marburg virus siRNA sense strand
aagccgaaauuuaucagcauc

SEQ ID NO: 32861 - RNA, 21 nt, Artificial Sequence
  Marburg virus siRNA sense strand
agccgaaauuuaucagcaucu

SEQ ID NO: 32862 - RNA, 21 nt, Artificial Sequence
  Marburg virus siRNA sense strand
gccgaaauuuaucagcaucuu

SEQ ID NO: 32863 - RNA, 21 nt, Artificial Sequence
  Marburg virus siRNA sense strand
ccgaaauuuaucagcaucuuu

SEQ ID NO: 32864 - RNA, 21 nt, Artificial Sequence
  Marburg virus siRNA sense strand
cgaaauuuaucagcaucuuug

SEQ ID NO: 32865 - RNA, 21 nt, Artificial Sequence
  Marburg virus siRNA sense strand
gaaauuuaucagcaucuuugg

SEQ ID NO: 32866 - RNA, 21 nt, Artificial Sequence
  Marburg virus siRNA sense strand
aaauuuaucagcaucuuuggg

SEQ ID NO: 32867 - RNA, 21 nt, Artificial Sequence
  Marburg virus siRNA sense strand
aauuuaucagcaucuuuggga

SEQ ID NO: 32868 - RNA, 21 nt, Artificial Sequence
  Marburg virus siRNA sense strand
auuuaucagcaucuuugggag

SEQ ID NO: 32869 - RNA, 21 nt, Artificial Sequence
  Marburg virus siRNA sense strand
uuuaucagcaucuuugggagu

SEQ ID NO: 32870 - RNA, 21 nt, Artificial Sequence
  Marburg virus siRNA sense strand
uuaucagcaucuuugggagug

SEQ ID NO: 32871 - RNA, 21 nt, Artificial Sequence
  Marburg virus siRNA sense strand
uaucagcaucuuugggagugg

SEQ ID NO: 32872 - RNA, 21 nt, Artificial Sequence
  Marburg virus siRNA sense strand
aucagcaucuuugggaguggu

SEQ ID NO: 32873 - RNA, 21 nt, Artificial Sequence
  Marburg virus siRNA sense strand
ucagcaucuuugggaguggua

SEQ ID NO: 32874 - RNA, 21 nt, Artificial Sequence
  Marburg virus siRNA sense strand
cagcaucuuugggagugguau

SEQ ID NO: 32875 - RNA, 21 nt, Artificial Sequence
  Marburg virus siRNA sense strand
agcaucuuugggagugguauu

SEQ ID NO: 32876 - RNA, 21 nt, Artificial Sequence
  Marburg virus siRNA sense strand
gcaucuuugggagugguauuu

SEQ ID NO: 32877 - RNA, 21 nt, Artificial Sequence
  Marburg virus siRNA sense strand
caucuuugggagugguauuuc

SEQ ID NO: 32878 - RNA, 21 nt, Artificial Sequence
  Marburg virus siRNA sense strand
aucuuugggagugguauuucg

SEQ ID NO: 32879 - RNA, 21 nt, Artificial Sequence
  Marburg virus siRNA sense strand
ucuuugggagugguauuucgu

SEQ ID NO: 32880 - RNA, 21 nt, Artificial Sequence
  Marburg virus siRNA sense strand
cuuugggagugguauuucgug

SEQ ID NO: 32881 - RNA, 21 nt, Artificial Sequence
  Marburg virus siRNA sense strand
uuugggagugguauuucgugg

SEQ ID NO: 32882 - RNA, 21 nt, Artificial Sequence
  Marburg virus siRNA sense strand
uugggagugguauuucgugga

SEQ ID NO: 32883 - RNA, 21 nt, Artificial Sequence
  Marburg virus siRNA sense strand
ugggagugguauuucguggag

SEQ ID NO: 32884 - RNA, 21 nt, Artificial Sequence
  Marburg virus siRNA sense strand
gggagugguauuucguggagc

SEQ ID NO: 32885 - RNA, 21 nt, Artificial Sequence
  Marburg virus siRNA sense strand
ggagugguauuucguggagca

SEQ ID NO: 32886 - RNA, 21 nt, Artificial Sequence
  Marburg virus siRNA sense strand
gagugguauuucguggagcau

SEQ ID NO: 32887 - RNA, 21 nt, Artificial Sequence
  Marburg virus siRNA sense strand
agugguauuucguggagcaug

SEQ ID NO: 32888 - RNA, 21 nt, Artificial Sequence
  Marburg virus siRNA sense strand
gugguauuucguggagcauga

SEQ ID NO: 32889 - RNA, 21 nt, Artificial Sequence
  Marburg virus siRNA sense strand
ugguauuucguggagcaugaa

SEQ ID NO: 32890 - RNA, 21 nt, Artificial Sequence
  Marburg virus siRNA sense strand
gguauuucguggagcaugaac

SEQ ID NO: 32891 - RNA, 21 nt, Artificial Sequence
  Marburg virus siRNA sense strand
guauuucguggagcaugaacc

SEQ ID NO: 32892 - RNA, 21 nt, Artificial Sequence
  Marburg virus siRNA sense strand
uauuucguggagcaugaaccu

SEQ ID NO: 32893 - RNA, 21 nt, Artificial Sequence
  Marburg virus siRNA sense strand
auuucguggagcaugaaccuc

SEQ ID NO: 32894 - RNA, 21 nt, Artificial Sequence
  Marburg virus siRNA sense strand
uuucguggagcaugaaccucu

SEQ ID NO: 32895 - RNA, 21 nt, Artificial Sequence
  Marburg virus siRNA sense strand
uucguggagcaugaaccucuu

SEQ ID NO: 32896 - RNA, 21 nt, Artificial Sequence
  Marburg virus siRNA sense strand
ucguggagcaugaaccucuuu

SEQ ID NO: 32897 - RNA, 21 nt, Artificial Sequence
  Marburg virus siRNA sense strand
cguggagcaugaaccucuuuu

SEQ ID NO: 32898 - RNA, 21 nt, Artificial Sequence
  Marburg virus siRNA sense strand
guggagcaugaaccucuuuuc

SEQ ID NO: 32899 - RNA, 21 nt, Artificial Sequence
  Marburg virus siRNA sense strand
uggagcaugaaccucuuuucu

SEQ ID NO: 32900 - RNA, 21 nt, Artificial Sequence
  Marburg virus siRNA sense strand
ggagcaugaaccucuuuucuc

SEQ ID NO: 32901 - RNA, 21 nt, Artificial Sequence
  Marburg virus siRNA sense strand
gagcaugaaccucuuuucuca

SEQ ID NO: 32902 - RNA, 21 nt, Artificial Sequence
  Marburg virus siRNA sense strand
agcaugaaccucuuuucucaa

SEQ ID NO: 32903 - RNA, 21 nt, Artificial Sequence
  Marburg virus siRNA sense strand
gcaugaaccucuuuucucaac

SEQ ID NO: 32904 - RNA, 21 nt, Artificial Sequence
  Marburg virus siRNA sense strand
caugaaccucuuuucucaacu

SEQ ID NO: 32905 - RNA, 21 nt, Artificial Sequence
  Marburg virus siRNA sense strand
augaaccucuuuucucaacua

SEQ ID NO: 32906 - RNA, 21 nt, Artificial Sequence
  Marburg virus siRNA sense strand
ugaaccucuuuucucaacuaa

SEQ ID NO: 32907 - RNA, 21 nt, Artificial Sequence
  Marburg virus siRNA sense strand
gaaccucuuuucucaacuaaa

SEQ ID NO: 32908 - RNA, 21 nt, Artificial Sequence
  Marburg virus siRNA sense strand
aaccucuuuucucaacuaaaa

SEQ ID NO: 32909 - RNA, 21 nt, Artificial Sequence
  Marburg virus siRNA sense strand
accucuuuucucaacuaaaau

SEQ ID NO: 32910 - RNA, 21 nt, Artificial Sequence
  Marburg virus siRNA sense strand
ccucuuuucucaacuaaaaua

SEQ ID NO: 32911 - RNA, 21 nt, Artificial Sequence
  Marburg virus siRNA sense strand
cucuuuucucaacuaaaauaa

SEQ ID NO: 32912 - RNA, 21 nt, Artificial Sequence
  Marburg virus siRNA sense strand
ucuuuucucaacuaaaauaau

SEQ ID NO: 32913 - RNA, 21 nt, Artificial Sequence
  Marburg virus siRNA sense strand
cuuuucucaacuaaaauaaua

SEQ ID NO: 32914 - RNA, 21 nt, Artificial Sequence
  Marburg virus siRNA sense strand
uuuucucaacuaaaauaauaa

SEQ ID NO: 32915 - RNA, 21 nt, Artificial Sequence
  Marburg virus siRNA sense strand
uuucucaacuaaaauaauaag

SEQ ID NO: 32916 - RNA, 21 nt, Artificial Sequence
  Marburg virus siRNA sense strand
uucucaacuaaaauaauaagu

SEQ ID NO: 32917 - RNA, 21 nt, Artificial Sequence
  Marburg virus siRNA sense strand
ucucaacuaaaauaauaagug

SEQ ID NO: 32918 - RNA, 21 nt, Artificial Sequence
  Marburg virus siRNA sense strand
cucaacuaaaauaauaaguga

SEQ ID NO: 32919 - RNA, 21 nt, Artificial Sequence
  Marburg virus siRNA sense strand
ucaacuaaaauaauaagugau

SEQ ID NO: 32920 - RNA, 21 nt, Artificial Sequence
  Marburg virus siRNA sense strand
caacuaaaauaauaagugauu

SEQ ID NO: 32921 - RNA, 21 nt, Artificial Sequence
  Marburg virus siRNA sense strand
aacuaaaauaauaagugauuu

SEQ ID NO: 32922 - RNA, 21 nt, Artificial Sequence
  Marburg virus siRNA sense strand
acuaaaauaauaagugauuua

SEQ ID NO: 32923 - RNA, 21 nt, Artificial Sequence
  Marburg virus siRNA sense strand
cuaaaauaauaagugauuuaa

SEQ ID NO: 32924 - RNA, 21 nt, Artificial Sequence
  Marburg virus siRNA sense strand
uaaaauaauaagugauuuaag

SEQ ID NO: 32925 - RNA, 21 nt, Artificial Sequence
  Marburg virus siRNA sense strand
aaaauaauaagugauuuaagu

SEQ ID NO: 32926 - RNA, 21 nt, Artificial Sequence
  Marburg virus siRNA sense strand
aaauaauaagugauuuaagua

SEQ ID NO: 32927 - RNA, 21 nt, Artificial Sequence
  Marburg virus siRNA sense strand
aauaauaagugauuuaaguau

SEQ ID NO: 32928 - RNA, 21 nt, Artificial Sequence
  Marburg virus siRNA sense strand
auaauaagugauuuaaguauu

SEQ ID NO: 32929 - RNA, 21 nt, Artificial Sequence
  Marburg virus siRNA sense strand
uaauaagugauuuaaguauuu

SEQ ID NO: 32930 - RNA, 21 nt, Artificial Sequence
  Marburg virus siRNA sense strand
aauaagugauuuaaguauuuu

SEQ ID NO: 32931 - RNA, 21 nt, Artificial Sequence
  Marburg virus siRNA sense strand
auaagugauuuaaguauuuuu

SEQ ID NO: 32932 - RNA, 21 nt, Artificial Sequence
  Marburg virus siRNA sense strand
uaagugauuuaaguauuuuua

SEQ ID NO: 32933 - RNA, 21 nt, Artificial Sequence
  Marburg virus siRNA sense strand
aagugauuuaaguauuuuuau

SEQ ID NO: 32934 - RNA, 21 nt, Artificial Sequence
  Marburg virus siRNA sense strand
agugauuuaaguauuuuuaua

SEQ ID NO: 32935 - RNA, 21 nt, Artificial Sequence
  Marburg virus siRNA sense strand
gugauuuaaguauuuuuauaa

SEQ ID NO: 32936 - RNA, 21 nt, Artificial Sequence
  Marburg virus siRNA sense strand
ugauuuaaguauuuuuauaaa

SEQ ID NO: 32937 - RNA, 21 nt, Artificial Sequence
  Marburg virus siRNA sense strand
gauuuaaguauuuuuauaaaa

SEQ ID NO: 32938 - RNA, 21 nt, Artificial Sequence
  Marburg virus siRNA sense strand
auuuaaguauuuuuauaaaag

SEQ ID NO: 32939 - RNA, 21 nt, Artificial Sequence
  Marburg virus siRNA sense strand
uuuaaguauuuuuauaaaaga

SEQ ID NO: 32940 - RNA, 21 nt, Artificial Sequence
  Marburg virus siRNA sense strand
uuaaguauuuuuauaaaagac

SEQ ID NO: 32941 - RNA, 21 nt, Artificial Sequence
  Marburg virus siRNA sense strand
uaaguauuuuuauaaaagaca

SEQ ID NO: 32942 - RNA, 21 nt, Artificial Sequence
  Marburg virus siRNA sense strand
aaguauuuuuauaaaagacag

SEQ ID NO: 32943 - RNA, 21 nt, Artificial Sequence
  Marburg virus siRNA sense strand
aguauuuuuauaaaagacagg

SEQ ID NO: 32944 - RNA, 21 nt, Artificial Sequence
  Marburg virus siRNA sense strand
guauuuuuauaaaagacaggg

SEQ ID NO: 32945 - RNA, 21 nt, Artificial Sequence
  Marburg virus siRNA sense strand
uauuuuuauaaaagacagggc

SEQ ID NO: 32946 - RNA, 21 nt, Artificial Sequence
  Marburg virus siRNA sense strand
auuuuuauaaaagacagggcu

SEQ ID NO: 32947 - RNA, 21 nt, Artificial Sequence
  Marburg virus siRNA sense strand
uuuuuauaaaagacagggcua

SEQ ID NO: 32948 - RNA, 21 nt, Artificial Sequence
  Marburg virus siRNA sense strand
uuuuauaaaagacagggcuac

SEQ ID NO: 32949 - RNA, 21 nt, Artificial Sequence
  Marburg virus siRNA sense strand
uuuauaaaagacagggcuacu

SEQ ID NO: 32950 - RNA, 21 nt, Artificial Sequence
  Marburg virus siRNA sense strand
uuauaaaagacagggcuacug

SEQ ID NO: 32951 - RNA, 21 nt, Artificial Sequence
  Marburg virus siRNA sense strand
uauaaaagacagggcuacugc

SEQ ID NO: 32952 - RNA, 21 nt, Artificial Sequence
  Marburg virus siRNA sense strand
auaaaagacagggcuacugcu

SEQ ID NO: 32953 - RNA, 21 nt, Artificial Sequence
  Marburg virus siRNA sense strand
uaaaagacagggcuacugcug

SEQ ID NO: 32954 - RNA, 21 nt, Artificial Sequence
  Marburg virus siRNA sense strand
aaaagacagggcuacugcugu

SEQ ID NO: 32955 - RNA, 21 nt, Artificial Sequence
  Marburg virus siRNA sense strand
aaagacagggcuacugcugug

SEQ ID NO: 32956 - RNA, 21 nt, Artificial Sequence
  Marburg virus siRNA sense strand
aagacagggcuacugcuguga

SEQ ID NO: 32957 - RNA, 21 nt, Artificial Sequence
  Marburg virus siRNA sense strand
agacagggcuacugcugugaa

SEQ ID NO: 32958 - RNA, 21 nt, Artificial Sequence
  Marburg virus siRNA sense strand
gacagggcuacugcugugaac

SEQ ID NO: 32959 - RNA, 21 nt, Artificial Sequence
  Marburg virus siRNA sense strand
acagggcuacugcugugaacc

SEQ ID NO: 32960 - RNA, 21 nt, Artificial Sequence
  Marburg virus siRNA sense strand
cagggcuacugcugugaacca

SEQ ID NO: 32961 - RNA, 21 nt, Artificial Sequence
  Marburg virus siRNA sense strand
agggcuacugcugugaaccag

SEQ ID NO: 32962 - RNA, 21 nt, Artificial Sequence
  Marburg virus siRNA sense strand
gggcuacugcugugaaccagg

SEQ ID NO: 32963 - RNA, 21 nt, Artificial Sequence
  Marburg virus siRNA sense strand
ggcuacugcugugaaccagga

SEQ ID NO: 32964 - RNA, 21 nt, Artificial Sequence
  Marburg virus siRNA sense strand
gcuacugcugugaaccaggag

SEQ ID NO: 32965 - RNA, 21 nt, Artificial Sequence
  Marburg virus siRNA sense strand
cuacugcugugaaccaggagu

SEQ ID NO: 32966 - RNA, 21 nt, Artificial Sequence
  Marburg virus siRNA sense strand
uacugcugugaaccaggagug

SEQ ID NO: 32967 - RNA, 21 nt, Artificial Sequence
  Marburg virus siRNA sense strand
acugcugugaaccaggagugu

SEQ ID NO: 32968 - RNA, 21 nt, Artificial Sequence
  Marburg virus siRNA sense strand
cugcugugaaccaggaguguu

SEQ ID NO: 32969 - RNA, 21 nt, Artificial Sequence
  Marburg virus siRNA sense strand
ugcugugaaccaggaguguug

SEQ ID NO: 32970 - RNA, 21 nt, Artificial Sequence
  Marburg virus siRNA sense strand
gcugugaaccaggaguguugg

SEQ ID NO: 32971 - RNA, 21 nt, Artificial Sequence
  Marburg virus siRNA sense strand
cugugaaccaggaguguuggg

SEQ ID NO: 32972 - RNA, 21 nt, Artificial Sequence
  Marburg virus siRNA sense strand
ugugaaccaggaguguuggga

SEQ ID NO: 32973 - RNA, 21 nt, Artificial Sequence
  Marburg virus siRNA sense strand
gugaaccaggaguguugggac

SEQ ID NO: 32974 - RNA, 21 nt, Artificial Sequence
  Marburg virus siRNA sense strand
ugaaccaggaguguugggaca

SEQ ID NO: 32975 - RNA, 21 nt, Artificial Sequence
  Marburg virus siRNA sense strand
gaaccaggaguguugggacag

SEQ ID NO: 32976 - RNA, 21 nt, Artificial Sequence
  Marburg virus siRNA sense strand
aaccaggaguguugggacagu

SEQ ID NO: 32977 - RNA, 21 nt, Artificial Sequence
  Marburg virus siRNA sense strand
accaggaguguugggacagug

SEQ ID NO: 32978 - RNA, 21 nt, Artificial Sequence
  Marburg virus siRNA sense strand
ccaggaguguugggacagugu

SEQ ID NO: 32979 - RNA, 21 nt, Artificial Sequence
  Marburg virus siRNA sense strand
caggaguguugggacaguguu

SEQ ID NO: 32980 - RNA, 21 nt, Artificial Sequence
  Marburg virus siRNA sense strand
aggaguguugggacaguguuu

SEQ ID NO: 32981 - RNA, 21 nt, Artificial Sequence
  Marburg virus siRNA sense strand
ggaguguugggacaguguuuu

SEQ ID NO: 32982 - RNA, 21 nt, Artificial Sequence
  Marburg virus siRNA sense strand
gaguguugggacaguguuuuc

SEQ ID NO: 32983 - RNA, 21 nt, Artificial Sequence
  Marburg virus siRNA sense strand
aguguugggacaguguuuucg

SEQ ID NO: 32984 - RNA, 21 nt, Artificial Sequence
  Marburg virus siRNA sense strand
guguugggacaguguuuucga

SEQ ID NO: 32985 - RNA, 21 nt, Artificial Sequence
  Marburg virus siRNA sense strand
uguugggacaguguuuucgau

SEQ ID NO: 32986 - RNA, 21 nt, Artificial Sequence
  Marburg virus siRNA sense strand
guugggacaguguuuucgaua

SEQ ID NO: 32987 - RNA, 21 nt, Artificial Sequence
  Marburg virus siRNA sense strand
uugggacaguguuuucgauag

SEQ ID NO: 32988 - RNA, 21 nt, Artificial Sequence
  Marburg virus siRNA sense strand
ugggacaguguuuucgauaga

SEQ ID NO: 32989 - RNA, 21 nt, Artificial Sequence
  Marburg virus siRNA sense strand
gggacaguguuuucgauagaa

SEQ ID NO: 32990 - RNA, 21 nt, Artificial Sequence
  Marburg virus siRNA sense strand
ggacaguguuuucgauagaag

SEQ ID NO: 32991 - RNA, 21 nt, Artificial Sequence
  Marburg virus siRNA sense strand
gacaguguuuucgauagaagu

SEQ ID NO: 32992 - RNA, 21 nt, Artificial Sequence
  Marburg virus siRNA sense strand
acaguguuuucgauagaagug

SEQ ID NO: 32993 - RNA, 21 nt, Artificial Sequence
  Marburg virus siRNA sense strand
caguguuuucgauagaagugu

SEQ ID NO: 32994 - RNA, 21 nt, Artificial Sequence
  Marburg virus siRNA sense strand
aguguuuucgauagaagugua

SEQ ID NO: 32995 - RNA, 21 nt, Artificial Sequence
  Marburg virus siRNA sense strand
guguuuucgauagaaguguau

SEQ ID NO: 32996 - RNA, 21 nt, Artificial Sequence
  Marburg virus siRNA sense strand
uguuuucgauagaaguguauu

SEQ ID NO: 32997 - RNA, 21 nt, Artificial Sequence
  Marburg virus siRNA sense strand
guuuucgauagaaguguauua

SEQ ID NO: 32998 - RNA, 21 nt, Artificial Sequence
  Marburg virus siRNA sense strand
uuuucgauagaaguguauuag

SEQ ID NO: 32999 - RNA, 21 nt, Artificial Sequence
  Marburg virus siRNA sense strand
uuucgauagaaguguauuagg

SEQ ID NO: 33000 - RNA, 21 nt, Artificial Sequence
  Marburg virus siRNA sense strand
uucgauagaaguguauuaggg

SEQ ID NO: 33001 - RNA, 21 nt, Artificial Sequence
  Marburg virus siRNA sense strand
ucgauagaaguguauuagggu

SEQ ID NO: 33002 - RNA, 21 nt, Artificial Sequence
  Marburg virus siRNA sense strand
cgauagaaguguauuagggua

SEQ ID NO: 33003 - RNA, 21 nt, Artificial Sequence
  Marburg virus siRNA sense strand
gauagaaguguauuaggguau

SEQ ID NO: 33004 - RNA, 21 nt, Artificial Sequence
  Marburg virus siRNA sense strand
auagaaguguauuaggguaua

SEQ ID NO: 33005 - RNA, 21 nt, Artificial Sequence
  Marburg virus siRNA sense strand
uagaaguguauuaggguauaa

SEQ ID NO: 33006 - RNA, 21 nt, Artificial Sequence
  Marburg virus siRNA sense strand
agaaguguauuaggguauaac

SEQ ID NO: 33007 - RNA, 21 nt, Artificial Sequence
  Marburg virus siRNA sense strand
gaaguguauuaggguauaacc

SEQ ID NO: 33008 - RNA, 21 nt, Artificial Sequence
  Marburg virus siRNA sense strand
aaguguauuaggguauaaccc

SEQ ID NO: 33009 - RNA, 21 nt, Artificial Sequence
  Marburg virus siRNA sense strand
aguguauuaggguauaacccu

SEQ ID NO: 33010 - RNA, 21 nt, Artificial Sequence
  Marburg virus siRNA sense strand
guguauuaggguauaacccuc

SEQ ID NO: 33011 - RNA, 21 nt, Artificial Sequence
  Marburg virus siRNA sense strand
uguauuaggguauaacccucc

SEQ ID NO: 33012 - RNA, 21 nt, Artificial Sequence
  Marburg virus siRNA sense strand
guauuaggguauaacccuccu

SEQ ID NO: 33013 - RNA, 21 nt, Artificial Sequence
  Marburg virus siRNA sense strand
uauuaggguauaacccuccug

SEQ ID NO: 33014 - RNA, 21 nt, Artificial Sequence
  Marburg virus siRNA sense strand
auuaggguauaacccuccugu

SEQ ID NO: 33015 - RNA, 21 nt, Artificial Sequence
  Marburg virus siRNA sense strand
uuaggguauaacccuccuguu

SEQ ID NO: 33016 - RNA, 21 nt, Artificial Sequence
  Marburg virus siRNA sense strand
uaggguauaacccuccuguua

SEQ ID NO: 33017 - RNA, 21 nt, Artificial Sequence
  Marburg virus siRNA sense strand
aggguauaacccuccuguuag

SEQ ID NO: 33018 - RNA, 21 nt, Artificial Sequence
  Marburg virus siRNA sense strand
ggguauaacccuccuguuaga

SEQ ID NO: 33019 - RNA, 21 nt, Artificial Sequence
  Marburg virus siRNA sense strand
gguauaacccuccuguuagau

SEQ ID NO: 33020 - RNA, 21 nt, Artificial Sequence
  Marburg virus siRNA sense strand
guauaacccuccuguuagauu

SEQ ID NO: 33021 - RNA, 21 nt, Artificial Sequence
  Marburg virus siRNA sense strand
uauaacccuccuguuagauuu

SEQ ID NO: 33022 - RNA, 21 nt, Artificial Sequence
  Marburg virus siRNA sense strand
auaacccuccuguuagauuuc

SEQ ID NO: 33023 - RNA, 21 nt, Artificial Sequence
  Marburg virus siRNA sense strand
uaacccuccuguuagauuuca

SEQ ID NO: 33024 - RNA, 21 nt, Artificial Sequence
  Marburg virus siRNA sense strand
aacccuccuguuagauuucag

SEQ ID NO: 33025 - RNA, 21 nt, Artificial Sequence
  Marburg virus siRNA sense strand
acccuccuguuagauuucagu

SEQ ID NO: 33026 - RNA, 21 nt, Artificial Sequence
  Marburg virus siRNA sense strand
cccuccuguuagauuucaguc

SEQ ID NO: 33027 - RNA, 21 nt, Artificial Sequence
  Marburg virus siRNA sense strand
ccuccuguuagauuucaguca

SEQ ID NO: 33028 - RNA, 21 nt, Artificial Sequence
  Marburg virus siRNA sense strand
cuccuguuagauuucagucaa

SEQ ID NO: 33029 - RNA, 21 nt, Artificial Sequence
  Marburg virus siRNA sense strand
uccuguuagauuucagucaaa

SEQ ID NO: 33030 - RNA, 21 nt, Artificial Sequence
  Marburg virus siRNA sense strand
ccuguuagauuucagucaaag

SEQ ID NO: 33031 - RNA, 21 nt, Artificial Sequence
  Marburg virus siRNA sense strand
cuguuagauuucagucaaaga

SEQ ID NO: 33032 - RNA, 21 nt, Artificial Sequence
  Marburg virus siRNA sense strand
uguuagauuucagucaaagag

SEQ ID NO: 33033 - RNA, 21 nt, Artificial Sequence
  Marburg virus siRNA sense strand
guuagauuucagucaaagaga

SEQ ID NO: 33034 - RNA, 21 nt, Artificial Sequence
  Marburg virus siRNA sense strand
uuagauuucagucaaagagag

SEQ ID NO: 33035 - RNA, 21 nt, Artificial Sequence
  Marburg virus siRNA sense strand
uagauuucagucaaagagagu

SEQ ID NO: 33036 - RNA, 21 nt, Artificial Sequence
  Marburg virus siRNA sense strand
agauuucagucaaagagagug

SEQ ID NO: 33037 - RNA, 21 nt, Artificial Sequence
  Marburg virus siRNA sense strand
gauuucagucaaagagagugc

SEQ ID NO: 33038 - RNA, 21 nt, Artificial Sequence
  Marburg virus siRNA sense strand
auuucagucaaagagagugcc

SEQ ID NO: 33039 - RNA, 21 nt, Artificial Sequence
  Marburg virus siRNA sense strand
uuucagucaaagagagugcca

SEQ ID NO: 33040 - RNA, 21 nt, Artificial Sequence
  Marburg virus siRNA sense strand
uucagucaaagagagugccag

SEQ ID NO: 33041 - RNA, 21 nt, Artificial Sequence
  Marburg virus siRNA sense strand
ucagucaaagagagugccaga

SEQ ID NO: 33042 - RNA, 21 nt, Artificial Sequence
  Marburg virus siRNA sense strand
cagucaaagagagugccagag

SEQ ID NO: 33043 - RNA, 21 nt, Artificial Sequence
  Marburg virus siRNA sense strand
agucaaagagagugccagagc

SEQ ID NO: 33044 - RNA, 21 nt, Artificial Sequence
  Marburg virus siRNA sense strand
gucaaagagagugccagagca

SEQ ID NO: 33045 - RNA, 21 nt, Artificial Sequence
  Marburg virus siRNA sense strand
ucaaagagagugccagagcaa

SEQ ID NO: 33046 - RNA, 21 nt, Artificial Sequence
  Marburg virus siRNA sense strand
caaagagagugccagagcaau

SEQ ID NO: 33047 - RNA, 21 nt, Artificial Sequence
  Marburg virus siRNA sense strand
aaagagagugccagagcaauu

SEQ ID NO: 33048 - RNA, 21 nt, Artificial Sequence
  Marburg virus siRNA sense strand
aagagagugccagagcaauuu

SEQ ID NO: 33049 - RNA, 21 nt, Artificial Sequence
  Marburg virus siRNA sense strand
agagagugccagagcaauuuu

SEQ ID NO: 33050 - RNA, 21 nt, Artificial Sequence
  Marburg virus siRNA sense strand
gagagugccagagcaauuuuu

SEQ ID NO: 33051 - RNA, 21 nt, Artificial Sequence
  Marburg virus siRNA sense strand
agagugccagagcaauuuuug

SEQ ID NO: 33052 - RNA, 21 nt, Artificial Sequence
  Marburg virus siRNA sense strand
gagugccagagcaauuuuugg

SEQ ID NO: 33053 - RNA, 21 nt, Artificial Sequence
  Marburg virus siRNA sense strand
agugccagagcaauuuuuggg

SEQ ID NO: 33054 - RNA, 21 nt, Artificial Sequence
  Marburg virus siRNA sense strand
gugccagagcaauuuuugggc

SEQ ID NO: 33055 - RNA, 21 nt, Artificial Sequence
  Marburg virus siRNA sense strand
ugccagagcaauuuuugggcc

SEQ ID NO: 33056 - RNA, 21 nt, Artificial Sequence
  Marburg virus siRNA sense strand
gccagagcaauuuuugggcca

SEQ ID NO: 33057 - RNA, 21 nt, Artificial Sequence
  Marburg virus siRNA sense strand
ccagagcaauuuuugggccaa

SEQ ID NO: 33058 - RNA, 21 nt, Artificial Sequence
  Marburg virus siRNA sense strand
cagagcaauuuuugggccaag

SEQ ID NO: 33059 - RNA, 21 nt, Artificial Sequence
  Marburg virus siRNA sense strand
agagcaauuuuugggccaagc

SEQ ID NO: 33060 - RNA, 21 nt, Artificial Sequence
  Marburg virus siRNA sense strand
gagcaauuuuugggccaagca

SEQ ID NO: 33061 - RNA, 21 nt, Artificial Sequence
  Marburg virus siRNA sense strand
agcaauuuuugggccaagcag

SEQ ID NO: 33062 - RNA, 21 nt, Artificial Sequence
  Marburg virus siRNA sense strand
gcaauuuuugggccaagcaga

SEQ ID NO: 33063 - RNA, 21 nt, Artificial Sequence
  Marburg virus siRNA sense strand
caauuuuugggccaagcagac

SEQ ID NO: 33064 - RNA, 21 nt, Artificial Sequence
  Marburg virus siRNA sense strand
aauuuuugggccaagcagacu

SEQ ID NO: 33065 - RNA, 21 nt, Artificial Sequence
  Marburg virus siRNA sense strand
auuuuugggccaagcagacuu

SEQ ID NO: 33066 - RNA, 21 nt, Artificial Sequence
  Marburg virus siRNA sense strand
uuuuugggccaagcagacuuu

SEQ ID NO: 33067 - RNA, 21 nt, Artificial Sequence
  Marburg virus siRNA sense strand
uuuugggccaagcagacuuuu

SEQ ID NO: 33068 - RNA, 21 nt, Artificial Sequence
  Marburg virus siRNA sense strand
uuugggccaagcagacuuuuc

SEQ ID NO: 33069 - RNA, 21 nt, Artificial Sequence
  Marburg virus siRNA sense strand
uugggccaagcagacuuuucc

SEQ ID NO: 33070 - RNA, 21 nt, Artificial Sequence
  Marburg virus siRNA sense strand
ugggccaagcagacuuuuccu

SEQ ID NO: 33071 - RNA, 21 nt, Artificial Sequence
  Marburg virus siRNA sense strand
gggccaagcagacuuuuccuu

SEQ ID NO: 33072 - RNA, 21 nt, Artificial Sequence
  Marburg virus siRNA sense strand
ggccaagcagacuuuuccuug

SEQ ID NO: 33073 - RNA, 21 nt, Artificial Sequence
  Marburg virus siRNA sense strand
gccaagcagacuuuuccuuga

SEQ ID NO: 33074 - RNA, 21 nt, Artificial Sequence
  Marburg virus siRNA sense strand
ccaagcagacuuuuccuugaa

SEQ ID NO: 33075 - RNA, 21 nt, Artificial Sequence
  Marburg virus siRNA sense strand
caagcagacuuuuccuugaau

SEQ ID NO: 33076 - RNA, 21 nt, Artificial Sequence
  Marburg virus siRNA sense strand
aagcagacuuuuccuugaauc

SEQ ID NO: 33077 - RNA, 21 nt, Artificial Sequence
  Marburg virus siRNA sense strand
agcagacuuuuccuugaauca

SEQ ID NO: 33078 - RNA, 21 nt, Artificial Sequence
  Marburg virus siRNA sense strand
gcagacuuuuccuugaaucaa

SEQ ID NO: 33079 - RNA, 21 nt, Artificial Sequence
  Marburg virus siRNA sense strand
cagacuuuuccuugaaucaaa

SEQ ID NO: 33080 - RNA, 21 nt, Artificial Sequence
  Marburg virus siRNA sense strand
agacuuuuccuugaaucaaau

SEQ ID NO: 33081 - RNA, 21 nt, Artificial Sequence
  Marburg virus siRNA sense strand
gacuuuuccuugaaucaaaua

SEQ ID NO: 33082 - RNA, 21 nt, Artificial Sequence
  Marburg virus siRNA sense strand
acuuuuccuugaaucaaauau

SEQ ID NO: 33083 - RNA, 21 nt, Artificial Sequence
  Marburg virus siRNA sense strand
cuuuuccuugaaucaaauauu

SEQ ID NO: 33084 - RNA, 21 nt, Artificial Sequence
  Marburg virus siRNA sense strand
uuuuccuugaaucaaauauug

SEQ ID NO: 33085 - RNA, 21 nt, Artificial Sequence
  Marburg virus siRNA sense strand
uuuccuugaaucaaauauugg

SEQ ID NO: 33086 - RNA, 21 nt, Artificial Sequence
  Marburg virus siRNA sense strand
uuccuugaaucaaauauugga

SEQ ID NO: 33087 - RNA, 21 nt, Artificial Sequence
  Marburg virus siRNA sense strand
uccuugaaucaaauauuggau

SEQ ID NO: 33088 - RNA, 21 nt, Artificial Sequence
  Marburg virus siRNA sense strand
ccuugaaucaaauauuggauu

SEQ ID NO: 33089 - RNA, 21 nt, Artificial Sequence
  Marburg virus siRNA sense strand
cuugaaucaaauauuggauuu

SEQ ID NO: 33090 - RNA, 21 nt, Artificial Sequence
  Marburg virus siRNA sense strand
uugaaucaaauauuggauuuu

SEQ ID NO: 33091 - RNA, 21 nt, Artificial Sequence
  Marburg virus siRNA sense strand
ugaaucaaauauuggauuuug

SEQ ID NO: 33092 - RNA, 21 nt, Artificial Sequence
  Marburg virus siRNA sense strand
gaaucaaauauuggauuuugc

SEQ ID NO: 33093 - RNA, 21 nt, Artificial Sequence
  Marburg virus siRNA sense strand
aaucaaauauuggauuuugcu

SEQ ID NO: 33094 - RNA, 21 nt, Artificial Sequence
  Marburg virus siRNA sense strand
aucaaauauuggauuuugcug

SEQ ID NO: 33095 - RNA, 21 nt, Artificial Sequence
  Marburg virus siRNA sense strand
ucaaauauuggauuuugcuga

SEQ ID NO: 33096 - RNA, 21 nt, Artificial Sequence
  Marburg virus siRNA sense strand
caaauauuggauuuugcugaa

SEQ ID NO: 33097 - RNA, 21 nt, Artificial Sequence
  Marburg virus siRNA sense strand
aaauauuggauuuugcugaaa

SEQ ID NO: 33098 - RNA, 21 nt, Artificial Sequence
  Marburg virus siRNA sense strand
aauauuggauuuugcugaaaa

SEQ ID NO: 33099 - RNA, 21 nt, Artificial Sequence
  Marburg virus siRNA sense strand
auauuggauuuugcugaaaag

SEQ ID NO: 33100 - RNA, 21 nt, Artificial Sequence
  Marburg virus siRNA sense strand
uauuggauuuugcugaaaagu

SEQ ID NO: 33101 - RNA, 21 nt, Artificial Sequence
  Marburg virus siRNA sense strand
auuggauuuugcugaaaaguu

SEQ ID NO: 33102 - RNA, 21 nt, Artificial Sequence
  Marburg virus siRNA sense strand
uuggauuuugcugaaaaguua

SEQ ID NO: 33103 - RNA, 21 nt, Artificial Sequence
  Marburg virus siRNA sense strand
uggauuuugcugaaaaguuag

SEQ ID NO: 33104 - RNA, 21 nt, Artificial Sequence
  Marburg virus siRNA sense strand
ggauuuugcugaaaaguuaga

SEQ ID NO: 33105 - RNA, 21 nt, Artificial Sequence
  Marburg virus siRNA sense strand
gauuuugcugaaaaguuagaa

SEQ ID NO: 33106 - RNA, 21 nt, Artificial Sequence
  Marburg virus siRNA sense strand
auuuugcugaaaaguuagaau

SEQ ID NO: 33107 - RNA, 21 nt, Artificial Sequence
  Marburg virus siRNA sense strand
uuuugcugaaaaguuagaaua

SEQ ID NO: 33108 - RNA, 21 nt, Artificial Sequence
  Marburg virus siRNA sense strand
uuugcugaaaaguuagaauau

SEQ ID NO: 33109 - RNA, 21 nt, Artificial Sequence
  Marburg virus siRNA sense strand
uugcugaaaaguuagaauauu

SEQ ID NO: 33110 - RNA, 21 nt, Artificial Sequence
  Marburg virus siRNA sense strand
ugcugaaaaguuagaauauuu

SEQ ID NO: 33111 - RNA, 21 nt, Artificial Sequence
  Marburg virus siRNA sense strand
gcugaaaaguuagaauauuug

SEQ ID NO: 33112 - RNA, 21 nt, Artificial Sequence
  Marburg virus siRNA sense strand
cugaaaaguuagaauauuugg

SEQ ID NO: 33113 - RNA, 21 nt, Artificial Sequence
  Marburg virus siRNA sense strand
ugaaaaguuagaauauuuggc

SEQ ID NO: 33114 - RNA, 21 nt, Artificial Sequence
  Marburg virus siRNA sense strand
gaaaaguuagaauauuuggcu

SEQ ID NO: 33115 - RNA, 21 nt, Artificial Sequence
  Marburg virus siRNA sense strand
aaaaguuagaauauuuggcuc

SEQ ID NO: 33116 - RNA, 21 nt, Artificial Sequence
  Marburg virus siRNA sense strand
aaaguuagaauauuuggcucc

SEQ ID NO: 33117 - RNA, 21 nt, Artificial Sequence
  Marburg virus siRNA sense strand
aaguuagaauauuuggcuccu

SEQ ID NO: 33118 - RNA, 21 nt, Artificial Sequence
  Marburg virus siRNA sense strand
aguuagaauauuuggcuccuu

SEQ ID NO: 33119 - RNA, 21 nt, Artificial Sequence
  Marburg virus siRNA sense strand
guuagaauauuuggcuccuuc

SEQ ID NO: 33120 - RNA, 21 nt, Artificial Sequence
  Marburg virus siRNA sense strand
uuagaauauuuggcuccuucu

SEQ ID NO: 33121 - RNA, 21 nt, Artificial Sequence
  Marburg virus siRNA sense strand
uagaauauuuggcuccuucuu

SEQ ID NO: 33122 - RNA, 21 nt, Artificial Sequence
  Marburg virus siRNA sense strand
agaauauuuggcuccuucuua

SEQ ID NO: 33123 - RNA, 21 nt, Artificial Sequence
  Marburg virus siRNA sense strand
gaauauuuggcuccuucuuau

SEQ ID NO: 33124 - RNA, 21 nt, Artificial Sequence
  Marburg virus siRNA sense strand
aauauuuggcuccuucuuaua

SEQ ID NO: 33125 - RNA, 21 nt, Artificial Sequence
  Marburg virus siRNA sense strand
auauuuggcuccuucuuauag

SEQ ID NO: 33126 - RNA, 21 nt, Artificial Sequence
  Marburg virus siRNA sense strand
uauuuggcuccuucuuauagg

SEQ ID NO: 33127 - RNA, 21 nt, Artificial Sequence
  Marburg virus siRNA sense strand
auuuggcuccuucuuauagga

SEQ ID NO: 33128 - RNA, 21 nt, Artificial Sequence
  Marburg virus siRNA sense strand
uuuggcuccuucuuauaggaa

SEQ ID NO: 33129 - RNA, 21 nt, Artificial Sequence
  Marburg virus siRNA sense strand
uuggcuccuucuuauaggaau

SEQ ID NO: 33130 - RNA, 21 nt, Artificial Sequence
  Marburg virus siRNA sense strand
uggcuccuucuuauaggaauu

SEQ ID NO: 33131 - RNA, 21 nt, Artificial Sequence
  Marburg virus siRNA sense strand
ggcuccuucuuauaggaauuu

SEQ ID NO: 33132 - RNA, 21 nt, Artificial Sequence
  Marburg virus siRNA sense strand
gcuccuucuuauaggaauuuu

SEQ ID NO: 33133 - RNA, 21 nt, Artificial Sequence
  Marburg virus siRNA sense strand
cuccuucuuauaggaauuuuu

SEQ ID NO: 33134 - RNA, 21 nt, Artificial Sequence
  Marburg virus siRNA sense strand
uccuucuuauaggaauuuuuc

SEQ ID NO: 33135 - RNA, 21 nt, Artificial Sequence
  Marburg virus siRNA sense strand
ccuucuuauaggaauuuuucc

SEQ ID NO: 33136 - RNA, 21 nt, Artificial Sequence
  Marburg virus siRNA sense strand
cuucuuauaggaauuuuuccu

SEQ ID NO: 33137 - RNA, 21 nt, Artificial Sequence
  Marburg virus siRNA sense strand
uucuuauaggaauuuuuccuu

SEQ ID NO: 33138 - RNA, 21 nt, Artificial Sequence
  Marburg virus siRNA sense strand
ucuuauaggaauuuuuccuuc

SEQ ID NO: 33139 - RNA, 21 nt, Artificial Sequence
  Marburg virus siRNA sense strand
cuuauaggaauuuuuccuucu

SEQ ID NO: 33140 - RNA, 21 nt, Artificial Sequence
  Marburg virus siRNA sense strand
uuauaggaauuuuuccuucuc

SEQ ID NO: 33141 - RNA, 21 nt, Artificial Sequence
  Marburg virus siRNA sense strand
uauaggaauuuuuccuucuca

SEQ ID NO: 33142 - RNA, 21 nt, Artificial Sequence
  Marburg virus siRNA sense strand
auaggaauuuuuccuucucau

SEQ ID NO: 33143 - RNA, 21 nt, Artificial Sequence
  Marburg virus siRNA sense strand
uaggaauuuuuccuucucauu

SEQ ID NO: 33144 - RNA, 21 nt, Artificial Sequence
  Marburg virus siRNA sense strand
aggaauuuuuccuucucauua

SEQ ID NO: 33145 - RNA, 21 nt, Artificial Sequence
  Marburg virus siRNA sense strand
ggaauuuuuccuucucauuaa

SEQ ID NO: 33146 - RNA, 21 nt, Artificial Sequence
  Marburg virus siRNA sense strand
gaauuuuuccuucucauuaaa

SEQ ID NO: 33147 - RNA, 21 nt, Artificial Sequence
  Marburg virus siRNA sense strand
aauuuuuccuucucauuaaaa

SEQ ID NO: 33148 - RNA, 21 nt, Artificial Sequence
  Marburg virus siRNA sense strand
auuuuuccuucucauuaaaag

SEQ ID NO: 33149 - RNA, 21 nt, Artificial Sequence
  Marburg virus siRNA sense strand
uuuuuccuucucauuaaaaga

SEQ ID NO: 33150 - RNA, 21 nt, Artificial Sequence
  Marburg virus siRNA sense strand
uuuuccuucucauuaaaagaa

SEQ ID NO: 33151 - RNA, 21 nt, Artificial Sequence
  Marburg virus siRNA sense strand
uuuccuucucauuaaaagaaa

SEQ ID NO: 33152 - RNA, 21 nt, Artificial Sequence
  Marburg virus siRNA sense strand
uuccuucucauuaaaagaaaa

SEQ ID NO: 33153 - RNA, 21 nt, Artificial Sequence
  Marburg virus siRNA sense strand
uccuucucauuaaaagaaaaa

SEQ ID NO: 33154 - RNA, 21 nt, Artificial Sequence
  Marburg virus siRNA sense strand
ccuucucauuaaaagaaaaag

SEQ ID NO: 33155 - RNA, 21 nt, Artificial Sequence
  Marburg virus siRNA sense strand
cuucucauuaaaagaaaaaga

SEQ ID NO: 33156 - RNA, 21 nt, Artificial Sequence
  Marburg virus siRNA sense strand
uucucauuaaaagaaaaagag

SEQ ID NO: 33157 - RNA, 21 nt, Artificial Sequence
  Marburg virus siRNA sense strand
ucucauuaaaagaaaaagagu

SEQ ID NO: 33158 - RNA, 21 nt, Artificial Sequence
  Marburg virus siRNA sense strand
cucauuaaaagaaaaagaguu

SEQ ID NO: 33159 - RNA, 21 nt, Artificial Sequence
  Marburg virus siRNA sense strand
ucauuaaaagaaaaagaguug

SEQ ID NO: 33160 - RNA, 21 nt, Artificial Sequence
  Marburg virus siRNA sense strand
cauuaaaagaaaaagaguuga

SEQ ID NO: 33161 - RNA, 21 nt, Artificial Sequence
  Marburg virus siRNA sense strand
auuaaaagaaaaagaguugaa

SEQ ID NO: 33162 - RNA, 21 nt, Artificial Sequence
  Marburg virus siRNA sense strand
uuaaaagaaaaagaguugaau

SEQ ID NO: 33163 - RNA, 21 nt, Artificial Sequence
  Marburg virus siRNA sense strand
uaaaagaaaaagaguugaaua

SEQ ID NO: 33164 - RNA, 21 nt, Artificial Sequence
  Marburg virus siRNA sense strand
aaaagaaaaagaguugaauau

SEQ ID NO: 33165 - RNA, 21 nt, Artificial Sequence
  Marburg virus siRNA sense strand
aaagaaaaagaguugaauaua

SEQ ID NO: 33166 - RNA, 21 nt, Artificial Sequence
  Marburg virus siRNA sense strand
aagaaaaagaguugaauauag

SEQ ID NO: 33167 - RNA, 21 nt, Artificial Sequence
  Marburg virus siRNA sense strand
agaaaaagaguugaauauagg

SEQ ID NO: 33168 - RNA, 21 nt, Artificial Sequence
  Marburg virus siRNA sense strand
gaaaaagaguugaauauagga

SEQ ID NO: 33169 - RNA, 21 nt, Artificial Sequence
  Marburg virus siRNA sense strand
aaaaagaguugaauauaggaa

SEQ ID NO: 33170 - RNA, 21 nt, Artificial Sequence
  Marburg virus siRNA sense strand
aaaagaguugaauauaggaag

SEQ ID NO: 33171 - RNA, 21 nt, Artificial Sequence
  Marburg virus siRNA sense strand
aaagaguugaauauaggaaga

SEQ ID NO: 33172 - RNA, 21 nt, Artificial Sequence
  Marburg virus siRNA sense strand
aagaguugaauauaggaagaa

SEQ ID NO: 33173 - RNA, 21 nt, Artificial Sequence
  Marburg virus siRNA sense strand
agaguugaauauaggaagaac

SEQ ID NO: 33174 - RNA, 21 nt, Artificial Sequence
  Marburg virus siRNA sense strand
gaguugaauauaggaagaacu

SEQ ID NO: 33175 - RNA, 21 nt, Artificial Sequence
  Marburg virus siRNA sense strand
aguugaauauaggaagaacuu

SEQ ID NO: 33176 - RNA, 21 nt, Artificial Sequence
  Marburg virus siRNA sense strand
guugaauauaggaagaacuuu

SEQ ID NO: 33177 - RNA, 21 nt, Artificial Sequence
  Marburg virus siRNA sense strand
uugaauauaggaagaacuuuu

SEQ ID NO: 33178 - RNA, 21 nt, Artificial Sequence
  Marburg virus siRNA sense strand
ugaauauaggaagaacuuuug

SEQ ID NO: 33179 - RNA, 21 nt, Artificial Sequence
  Marburg virus siRNA sense strand
gaauauaggaagaacuuuugg

SEQ ID NO: 33180 - RNA, 21 nt, Artificial Sequence
  Marburg virus siRNA sense strand
aauauaggaagaacuuuuggg

SEQ ID NO: 33181 - RNA, 21 nt, Artificial Sequence
  Marburg virus siRNA sense strand
auauaggaagaacuuuuggga

SEQ ID NO: 33182 - RNA, 21 nt, Artificial Sequence
  Marburg virus siRNA sense strand
uauaggaagaacuuuugggaa

SEQ ID NO: 33183 - RNA, 21 nt, Artificial Sequence
  Marburg virus siRNA sense strand
auaggaagaacuuuugggaaa

SEQ ID NO: 33184 - RNA, 21 nt, Artificial Sequence
  Marburg virus siRNA sense strand
uaggaagaacuuuugggaaau

SEQ ID NO: 33185 - RNA, 21 nt, Artificial Sequence
  Marburg virus siRNA sense strand
aggaagaacuuuugggaaauu

SEQ ID NO: 33186 - RNA, 21 nt, Artificial Sequence
  Marburg virus siRNA sense strand
ggaagaacuuuugggaaauua

SEQ ID NO: 33187 - RNA, 21 nt, Artificial Sequence
  Marburg virus siRNA sense strand
gaagaacuuuugggaaauuac

SEQ ID NO: 33188 - RNA, 21 nt, Artificial Sequence
  Marburg virus siRNA sense strand
aagaacuuuugggaaauuacc

SEQ ID NO: 33189 - RNA, 21 nt, Artificial Sequence
  Marburg virus siRNA sense strand
agaacuuuugggaaauuacca

SEQ ID NO: 33190 - RNA, 21 nt, Artificial Sequence
  Marburg virus siRNA sense strand
gaacuuuugggaaauuaccau

SEQ ID NO: 33191 - RNA, 21 nt, Artificial Sequence
  Marburg virus siRNA sense strand
aacuuuugggaaauuaccaua

SEQ ID NO: 33192 - RNA, 21 nt, Artificial Sequence
  Marburg virus siRNA sense strand
acuuuugggaaauuaccauau

SEQ ID NO: 33193 - RNA, 21 nt, Artificial Sequence
  Marburg virus siRNA sense strand
cuuuugggaaauuaccauauc

SEQ ID NO: 33194 - RNA, 21 nt, Artificial Sequence
  Marburg virus siRNA sense strand
uuuugggaaauuaccauaucg

SEQ ID NO: 33195 - RNA, 21 nt, Artificial Sequence
  Marburg virus siRNA sense strand
uuugggaaauuaccauaucgu

SEQ ID NO: 33196 - RNA, 21 nt, Artificial Sequence
  Marburg virus siRNA sense strand
uugggaaauuaccauaucgug

SEQ ID NO: 33197 - RNA, 21 nt, Artificial Sequence
  Marburg virus siRNA sense strand
ugggaaauuaccauaucgugu

SEQ ID NO: 33198 - RNA, 21 nt, Artificial Sequence
  Marburg virus siRNA sense strand
gggaaauuaccauaucguguc

SEQ ID NO: 33199 - RNA, 21 nt, Artificial Sequence
  Marburg virus siRNA sense strand
ggaaauuaccauaucguguca

SEQ ID NO: 33200 - RNA, 21 nt, Artificial Sequence
  Marburg virus siRNA sense strand
gaaauuaccauaucgugucag

SEQ ID NO: 33201 - RNA, 21 nt, Artificial Sequence
  Marburg virus siRNA sense strand
aaauuaccauaucgugucaga

SEQ ID NO: 33202 - RNA, 21 nt, Artificial Sequence
  Marburg virus siRNA sense strand
aauuaccauaucgugucagaa

SEQ ID NO: 33203 - RNA, 21 nt, Artificial Sequence
  Marburg virus siRNA sense strand
auuaccauaucgugucagaaa

SEQ ID NO: 33204 - RNA, 21 nt, Artificial Sequence
  Marburg virus siRNA sense strand
uuaccauaucgugucagaaau

SEQ ID NO: 33205 - RNA, 21 nt, Artificial Sequence
  Marburg virus siRNA sense strand
uaccauaucgugucagaaaug

SEQ ID NO: 33206 - RNA, 21 nt, Artificial Sequence
  Marburg virus siRNA sense strand
accauaucgugucagaaaugu

SEQ ID NO: 33207 - RNA, 21 nt, Artificial Sequence
  Marburg virus siRNA sense strand
ccauaucgugucagaaauguc

SEQ ID NO: 33208 - RNA, 21 nt, Artificial Sequence
  Marburg virus siRNA sense strand
cauaucgugucagaaaugucc

SEQ ID NO: 33209 - RNA, 21 nt, Artificial Sequence
  Marburg virus siRNA sense strand
auaucgugucagaaaugucca

SEQ ID NO: 33210 - RNA, 21 nt, Artificial Sequence
  Marburg virus siRNA sense strand
uaucgugucagaaauguccaa

SEQ ID NO: 33211 - RNA, 21 nt, Artificial Sequence
  Marburg virus siRNA sense strand
aucgugucagaaauguccaaa

SEQ ID NO: 33212 - RNA, 21 nt, Artificial Sequence
  Marburg virus siRNA sense strand
ucgugucagaaauguccaaac

SEQ ID NO: 33213 - RNA, 21 nt, Artificial Sequence
  Marburg virus siRNA sense strand
cgugucagaaauguccaaaca

SEQ ID NO: 33214 - RNA, 21 nt, Artificial Sequence
  Marburg virus siRNA sense strand
gugucagaaauguccaaacac

SEQ ID NO: 33215 - RNA, 21 nt, Artificial Sequence
  Marburg virus siRNA sense strand
ugucagaaauguccaaacacu

SEQ ID NO: 33216 - RNA, 21 nt, Artificial Sequence
  Marburg virus siRNA sense strand
gucagaaauguccaaacacuc

SEQ ID NO: 33217 - RNA, 21 nt, Artificial Sequence
  Marburg virus siRNA sense strand
ucagaaauguccaaacacucg

SEQ ID NO: 33218 - RNA, 21 nt, Artificial Sequence
  Marburg virus siRNA sense strand
cagaaauguccaaacacucgc

SEQ ID NO: 33219 - RNA, 21 nt, Artificial Sequence
  Marburg virus siRNA sense strand
agaaauguccaaacacucgca

SEQ ID NO: 33220 - RNA, 21 nt, Artificial Sequence
  Marburg virus siRNA sense strand
gaaauguccaaacacucgcag

SEQ ID NO: 33221 - RNA, 21 nt, Artificial Sequence
  Marburg virus siRNA sense strand
aaauguccaaacacucgcaga

SEQ ID NO: 33222 - RNA, 21 nt, Artificial Sequence
  Marburg virus siRNA sense strand
aauguccaaacacucgcagaa

SEQ ID NO: 33223 - RNA, 21 nt, Artificial Sequence
  Marburg virus siRNA sense strand
auguccaaacacucgcagaag

SEQ ID NO: 33224 - RNA, 21 nt, Artificial Sequence
  Marburg virus siRNA sense strand
uguccaaacacucgcagaagc

SEQ ID NO: 33225 - RNA, 21 nt, Artificial Sequence
  Marburg virus siRNA sense strand
guccaaacacucgcagaagcc

SEQ ID NO: 33226 - RNA, 21 nt, Artificial Sequence
  Marburg virus siRNA sense strand
uccaaacacucgcagaagccu

SEQ ID NO: 33227 - RNA, 21 nt, Artificial Sequence
  Marburg virus siRNA sense strand
ccaaacacucgcagaagccuu

SEQ ID NO: 33228 - RNA, 21 nt, Artificial Sequence
  Marburg virus siRNA sense strand
caaacacucgcagaagccuug

SEQ ID NO: 33229 - RNA, 21 nt, Artificial Sequence
  Marburg virus siRNA sense strand
aaacacucgcagaagccuugc

SEQ ID NO: 33230 - RNA, 21 nt, Artificial Sequence
  Marburg virus siRNA sense strand
aacacucgcagaagccuugcu

SEQ ID NO: 33231 - RNA, 21 nt, Artificial Sequence
  Marburg virus siRNA sense strand
acacucgcagaagccuugcua

SEQ ID NO: 33232 - RNA, 21 nt, Artificial Sequence
  Marburg virus siRNA sense strand
cacucgcagaagccuugcuag

SEQ ID NO: 33233 - RNA, 21 nt, Artificial Sequence
  Marburg virus siRNA sense strand
acucgcagaagccuugcuagc

SEQ ID NO: 33234 - RNA, 21 nt, Artificial Sequence
  Marburg virus siRNA sense strand
cucgcagaagccuugcuagca

SEQ ID NO: 33235 - RNA, 21 nt, Artificial Sequence
  Marburg virus siRNA sense strand
ucgcagaagccuugcuagcag

SEQ ID NO: 33236 - RNA, 21 nt, Artificial Sequence
  Marburg virus siRNA sense strand
cgcagaagccuugcuagcaga

SEQ ID NO: 33237 - RNA, 21 nt, Artificial Sequence
  Marburg virus siRNA sense strand
gcagaagccuugcuagcagau

SEQ ID NO: 33238 - RNA, 21 nt, Artificial Sequence
  Marburg virus siRNA sense strand
cagaagccuugcuagcagaug

SEQ ID NO: 33239 - RNA, 21 nt, Artificial Sequence
  Marburg virus siRNA sense strand
agaagccuugcuagcagaugg

SEQ ID NO: 33240 - RNA, 21 nt, Artificial Sequence
  Marburg virus siRNA sense strand
gaagccuugcuagcagaugga

SEQ ID NO: 33241 - RNA, 21 nt, Artificial Sequence
  Marburg virus siRNA sense strand
aagccuugcuagcagauggac

SEQ ID NO: 33242 - RNA, 21 nt, Artificial Sequence
  Marburg virus siRNA sense strand
agccuugcuagcagauggacu

SEQ ID NO: 33243 - RNA, 21 nt, Artificial Sequence
  Marburg virus siRNA sense strand
gccuugcuagcagauggacua

SEQ ID NO: 33244 - RNA, 21 nt, Artificial Sequence
  Marburg virus siRNA sense strand
ccuugcuagcagauggacuag

SEQ ID NO: 33245 - RNA, 21 nt, Artificial Sequence
  Marburg virus siRNA sense strand
cuugcuagcagauggacuagc

SEQ ID NO: 33246 - RNA, 21 nt, Artificial Sequence
  Marburg virus siRNA sense strand
uugcuagcagauggacuagca

SEQ ID NO: 33247 - RNA, 21 nt, Artificial Sequence
  Marburg virus siRNA sense strand
ugcuagcagauggacuagcaa

SEQ ID NO: 33248 - RNA, 21 nt, Artificial Sequence
  Marburg virus siRNA sense strand
gcuagcagauggacuagcaaa

SEQ ID NO: 33249 - RNA, 21 nt, Artificial Sequence
  Marburg virus siRNA sense strand
cuagcagauggacuagcaaaa

SEQ ID NO: 33250 - RNA, 21 nt, Artificial Sequence
  Marburg virus siRNA sense strand
uagcagauggacuagcaaaag

SEQ ID NO: 33251 - RNA, 21 nt, Artificial Sequence
  Marburg virus siRNA sense strand
agcagauggacuagcaaaagc

SEQ ID NO: 33252 - RNA, 21 nt, Artificial Sequence
  Marburg virus siRNA sense strand
gcagauggacuagcaaaagca

SEQ ID NO: 33253 - RNA, 21 nt, Artificial Sequence
  Marburg virus siRNA sense strand
cagauggacuagcaaaagcau

SEQ ID NO: 33254 - RNA, 21 nt, Artificial Sequence
  Marburg virus siRNA sense strand
agauggacuagcaaaagcauu

SEQ ID NO: 33255 - RNA, 21 nt, Artificial Sequence
  Marburg virus siRNA sense strand
gauggacuagcaaaagcauuc

SEQ ID NO: 33256 - RNA, 21 nt, Artificial Sequence
  Marburg virus siRNA sense strand
auggacuagcaaaagcauucc

SEQ ID NO: 33257 - RNA, 21 nt, Artificial Sequence
  Marburg virus siRNA sense strand
uggacuagcaaaagcauuccc

SEQ ID NO: 33258 - RNA, 21 nt, Artificial Sequence
  Marburg virus siRNA sense strand
ggacuagcaaaagcauucccu

SEQ ID NO: 33259 - RNA, 21 nt, Artificial Sequence
  Marburg virus siRNA sense strand
gacuagcaaaagcauucccua

SEQ ID NO: 33260 - RNA, 21 nt, Artificial Sequence
  Marburg virus siRNA sense strand
acuagcaaaagcauucccuag

SEQ ID NO: 33261 - RNA, 21 nt, Artificial Sequence
  Marburg virus siRNA sense strand
cuagcaaaagcauucccuagc

SEQ ID NO: 33262 - RNA, 21 nt, Artificial Sequence
  Marburg virus siRNA sense strand
uagcaaaagcauucccuagca

SEQ ID NO: 33263 - RNA, 21 nt, Artificial Sequence
  Marburg virus siRNA sense strand
agcaaaagcauucccuagcaa

SEQ ID NO: 33264 - RNA, 21 nt, Artificial Sequence
  Marburg virus siRNA sense strand
gcaaaagcauucccuagcaac

SEQ ID NO: 33265 - RNA, 21 nt, Artificial Sequence
  Marburg virus siRNA sense strand
caaaagcauucccuagcaaca

SEQ ID NO: 33266 - RNA, 21 nt, Artificial Sequence
  Marburg virus siRNA sense strand
aaaagcauucccuagcaacau

SEQ ID NO: 33267 - RNA, 21 nt, Artificial Sequence
  Marburg virus siRNA sense strand
aaagcauucccuagcaacaug

SEQ ID NO: 33268 - RNA, 21 nt, Artificial Sequence
  Marburg virus siRNA sense strand
aagcauucccuagcaacauga

SEQ ID NO: 33269 - RNA, 21 nt, Artificial Sequence
  Marburg virus siRNA sense strand
agcauucccuagcaacaugau

SEQ ID NO: 33270 - RNA, 21 nt, Artificial Sequence
  Marburg virus siRNA sense strand
gcauucccuagcaacaugaug

SEQ ID NO: 33271 - RNA, 21 nt, Artificial Sequence
  Marburg virus siRNA sense strand
cauucccuagcaacaugaugg

SEQ ID NO: 33272 - RNA, 21 nt, Artificial Sequence
  Marburg virus siRNA sense strand
auucccuagcaacaugauggu

SEQ ID NO: 33273 - RNA, 21 nt, Artificial Sequence
  Marburg virus siRNA sense strand
uucccuagcaacaugaugguu

SEQ ID NO: 33274 - RNA, 21 nt, Artificial Sequence
  Marburg virus siRNA sense strand
ucccuagcaacaugaugguug

SEQ ID NO: 33275 - RNA, 21 nt, Artificial Sequence
  Marburg virus siRNA sense strand
cccuagcaacaugaugguugu

SEQ ID NO: 33276 - RNA, 21 nt, Artificial Sequence
  Marburg virus siRNA sense strand
ccuagcaacaugaugguuguu

SEQ ID NO: 33277 - RNA, 21 nt, Artificial Sequence
  Marburg virus siRNA sense strand
cuagcaacaugaugguuguua

SEQ ID NO: 33278 - RNA, 21 nt, Artificial Sequence
  Marburg virus siRNA sense strand
uagcaacaugaugguuguuac

SEQ ID NO: 33279 - RNA, 21 nt, Artificial Sequence
  Marburg virus siRNA sense strand
agcaacaugaugguuguuacu

SEQ ID NO: 33280 - RNA, 21 nt, Artificial Sequence
  Marburg virus siRNA sense strand
gcaacaugaugguuguuacug

SEQ ID NO: 33281 - RNA, 21 nt, Artificial Sequence
  Marburg virus siRNA sense strand
caacaugaugguuguuacuga

SEQ ID NO: 33282 - RNA, 21 nt, Artificial Sequence
  Marburg virus siRNA sense strand
aacaugaugguuguuacugag

SEQ ID NO: 33283 - RNA, 21 nt, Artificial Sequence
  Marburg virus siRNA sense strand
acaugaugguuguuacugaga

SEQ ID NO: 33284 - RNA, 21 nt, Artificial Sequence
  Marburg virus siRNA sense strand
caugaugguuguuacugagag

SEQ ID NO: 33285 - RNA, 21 nt, Artificial Sequence
  Marburg virus siRNA sense strand
augaugguuguuacugagagg

SEQ ID NO: 33286 - RNA, 21 nt, Artificial Sequence
  Marburg virus siRNA sense strand
ugaugguuguuacugagaggg

SEQ ID NO: 33287 - RNA, 21 nt, Artificial Sequence
  Marburg virus siRNA sense strand
gaugguuguuacugagaggga

SEQ ID NO: 33288 - RNA, 21 nt, Artificial Sequence
  Marburg virus siRNA sense strand
augguuguuacugagagggaa

SEQ ID NO: 33289 - RNA, 21 nt, Artificial Sequence
  Marburg virus siRNA sense strand
ugguuguuacugagagggaac

SEQ ID NO: 33290 - RNA, 21 nt, Artificial Sequence
  Marburg virus siRNA sense strand
gguuguuacugagagggaaca

SEQ ID NO: 33291 - RNA, 21 nt, Artificial Sequence
  Marburg virus siRNA sense strand
guuguuacugagagggaacag

SEQ ID NO: 33292 - RNA, 21 nt, Artificial Sequence
  Marburg virus siRNA sense strand
uuguuacugagagggaacaga

SEQ ID NO: 33293 - RNA, 21 nt, Artificial Sequence
  Marburg virus siRNA sense strand
uguuacugagagggaacagaa

SEQ ID NO: 33294 - RNA, 21 nt, Artificial Sequence
  Marburg virus siRNA sense strand
guuacugagagggaacagaaa

SEQ ID NO: 33295 - RNA, 21 nt, Artificial Sequence
  Marburg virus siRNA sense strand
uuacugagagggaacagaaag

SEQ ID NO: 33296 - RNA, 21 nt, Artificial Sequence
  Marburg virus siRNA sense strand
uacugagagggaacagaaaga

SEQ ID NO: 33297 - RNA, 21 nt, Artificial Sequence
  Marburg virus siRNA sense strand
acugagagggaacagaaagaa

SEQ ID NO: 33298 - RNA, 21 nt, Artificial Sequence
  Marburg virus siRNA sense strand
cugagagggaacagaaagaag

SEQ ID NO: 33299 - RNA, 21 nt, Artificial Sequence
  Marburg virus siRNA sense strand
ugagagggaacagaaagaagc

SEQ ID NO: 33300 - RNA, 21 nt, Artificial Sequence
  Marburg virus siRNA sense strand
gagagggaacagaaagaagca

SEQ ID NO: 33301 - RNA, 21 nt, Artificial Sequence
  Marburg virus siRNA sense strand
agagggaacagaaagaagcau

SEQ ID NO: 33302 - RNA, 21 nt, Artificial Sequence
  Marburg virus siRNA sense strand
gagggaacagaaagaagcauu

SEQ ID NO: 33303 - RNA, 21 nt, Artificial Sequence
  Marburg virus siRNA sense strand
agggaacagaaagaagcauua

SEQ ID NO: 33304 - RNA, 21 nt, Artificial Sequence
  Marburg virus siRNA sense strand
gggaacagaaagaagcauuau

SEQ ID NO: 33305 - RNA, 21 nt, Artificial Sequence
  Marburg virus siRNA sense strand
ggaacagaaagaagcauuauu

SEQ ID NO: 33306 - RNA, 21 nt, Artificial Sequence
  Marburg virus siRNA sense strand
gaacagaaagaagcauuauug

SEQ ID NO: 33307 - RNA, 21 nt, Artificial Sequence
  Marburg virus siRNA sense strand
aacagaaagaagcauuauugc

SEQ ID NO: 33308 - RNA, 21 nt, Artificial Sequence
  Marburg virus siRNA sense strand
acagaaagaagcauuauugca

SEQ ID NO: 33309 - RNA, 21 nt, Artificial Sequence
  Marburg virus siRNA sense strand
cagaaagaagcauuauugcau

SEQ ID NO: 33310 - RNA, 21 nt, Artificial Sequence
  Marburg virus siRNA sense strand
agaaagaagcauuauugcauc

SEQ ID NO: 33311 - RNA, 21 nt, Artificial Sequence
  Marburg virus siRNA sense strand
gaaagaagcauuauugcauca

SEQ ID NO: 33312 - RNA, 21 nt, Artificial Sequence
  Marburg virus siRNA sense strand
aaagaagcauuauugcaucag

SEQ ID NO: 33313 - RNA, 21 nt, Artificial Sequence
  Marburg virus siRNA sense strand
aagaagcauuauugcaucagg

SEQ ID NO: 33314 - RNA, 21 nt, Artificial Sequence
  Marburg virus siRNA sense strand
agaagcauuauugcaucaggc

SEQ ID NO: 33315 - RNA, 21 nt, Artificial Sequence
  Marburg virus siRNA sense strand
gaagcauuauugcaucaggcu

SEQ ID NO: 33316 - RNA, 21 nt, Artificial Sequence
  Marburg virus siRNA sense strand
aagcauuauugcaucaggcuu

SEQ ID NO: 33317 - RNA, 21 nt, Artificial Sequence
  Marburg virus siRNA sense strand
agcauuauugcaucaggcuuc

SEQ ID NO: 33318 - RNA, 21 nt, Artificial Sequence
  Marburg virus siRNA sense strand
gcauuauugcaucaggcuucu

SEQ ID NO: 33319 - RNA, 21 nt, Artificial Sequence
  Marburg virus siRNA sense strand
cauuauugcaucaggcuucuu

SEQ ID NO: 33320 - RNA, 21 nt, Artificial Sequence
  Marburg virus siRNA sense strand
auuauugcaucaggcuucuug

SEQ ID NO: 33321 - RNA, 21 nt, Artificial Sequence
  Marburg virus siRNA sense strand
uuauugcaucaggcuucuugg

SEQ ID NO: 33322 - RNA, 21 nt, Artificial Sequence
  Marburg virus siRNA sense strand
uauugcaucaggcuucuuggc

SEQ ID NO: 33323 - RNA, 21 nt, Artificial Sequence
  Marburg virus siRNA sense strand
auugcaucaggcuucuuggca

SEQ ID NO: 33324 - RNA, 21 nt, Artificial Sequence
  Marburg virus siRNA sense strand
uugcaucaggcuucuuggcac

SEQ ID NO: 33325 - RNA, 21 nt, Artificial Sequence
  Marburg virus siRNA sense strand
ugcaucaggcuucuuggcacc

SEQ ID NO: 33326 - RNA, 21 nt, Artificial Sequence
  Marburg virus siRNA sense strand
gcaucaggcuucuuggcacca

SEQ ID NO: 33327 - RNA, 21 nt, Artificial Sequence
  Marburg virus siRNA sense strand
caucaggcuucuuggcaccac

SEQ ID NO: 33328 - RNA, 21 nt, Artificial Sequence
  Marburg virus siRNA sense strand
aucaggcuucuuggcaccaca

SEQ ID NO: 33329 - RNA, 21 nt, Artificial Sequence
  Marburg virus siRNA sense strand
ucaggcuucuuggcaccacaa

SEQ ID NO: 33330 - RNA, 21 nt, Artificial Sequence
  Marburg virus siRNA sense strand
caggcuucuuggcaccacaau

SEQ ID NO: 33331 - RNA, 21 nt, Artificial Sequence
  Marburg virus siRNA sense strand
aggcuucuuggcaccacaauu

SEQ ID NO: 33332 - RNA, 21 nt, Artificial Sequence
  Marburg virus siRNA sense strand
ggcuucuuggcaccacaauuc

SEQ ID NO: 33333 - RNA, 21 nt, Artificial Sequence
  Marburg virus siRNA sense strand
gcuucuuggcaccacaauuca

SEQ ID NO: 33334 - RNA, 21 nt, Artificial Sequence
  Marburg virus siRNA sense strand
cuucuuggcaccacaauucag

SEQ ID NO: 33335 - RNA, 21 nt, Artificial Sequence
  Marburg virus siRNA sense strand
uucuuggcaccacaauucagc

SEQ ID NO: 33336 - RNA, 21 nt, Artificial Sequence
  Marburg virus siRNA sense strand
ucuuggcaccacaauucagca

SEQ ID NO: 33337 - RNA, 21 nt, Artificial Sequence
  Marburg virus siRNA sense strand
cuuggcaccacaauucagcaa

SEQ ID NO: 33338 - RNA, 21 nt, Artificial Sequence
  Marburg virus siRNA sense strand
uuggcaccacaauucagcaag

SEQ ID NO: 33339 - RNA, 21 nt, Artificial Sequence
  Marburg virus siRNA sense strand
uggcaccacaauucagcaagc

SEQ ID NO: 33340 - RNA, 21 nt, Artificial Sequence
  Marburg virus siRNA sense strand
ggcaccacaauucagcaagca

SEQ ID NO: 33341 - RNA, 21 nt, Artificial Sequence
  Marburg virus siRNA sense strand
gcaccacaauucagcaagcau

SEQ ID NO: 33342 - RNA, 21 nt, Artificial Sequence
  Marburg virus siRNA sense strand
caccacaauucagcaagcaua

SEQ ID NO: 33343 - RNA, 21 nt, Artificial Sequence
  Marburg virus siRNA sense strand
accacaauucagcaagcauag

SEQ ID NO: 33344 - RNA, 21 nt, Artificial Sequence
  Marburg virus siRNA sense strand
ccacaauucagcaagcauagg

SEQ ID NO: 33345 - RNA, 21 nt, Artificial Sequence
  Marburg virus siRNA sense strand
cacaauucagcaagcauaggg

SEQ ID NO: 33346 - RNA, 21 nt, Artificial Sequence
  Marburg virus siRNA sense strand
acaauucagcaagcauagggg

SEQ ID NO: 33347 - RNA, 21 nt, Artificial Sequence
  Marburg virus siRNA sense strand
caauucagcaagcauagggga

SEQ ID NO: 33348 - RNA, 21 nt, Artificial Sequence
  Marburg virus siRNA sense strand
aauucagcaagcauaggggaa

SEQ ID NO: 33349 - RNA, 21 nt, Artificial Sequence
  Marburg virus siRNA sense strand
auucagcaagcauaggggaaa

SEQ ID NO: 33350 - RNA, 21 nt, Artificial Sequence
  Marburg virus siRNA sense strand
uucagcaagcauaggggaaaa

SEQ ID NO: 33351 - RNA, 21 nt, Artificial Sequence
  Marburg virus siRNA sense strand
ucagcaagcauaggggaaaac

SEQ ID NO: 33352 - RNA, 21 nt, Artificial Sequence
  Marburg virus siRNA sense strand
cagcaagcauaggggaaaacg

SEQ ID NO: 33353 - RNA, 21 nt, Artificial Sequence
  Marburg virus siRNA sense strand
agcaagcauaggggaaaacgc

SEQ ID NO: 33354 - RNA, 21 nt, Artificial Sequence
  Marburg virus siRNA sense strand
gcaagcauaggggaaaacgcu

SEQ ID NO: 33355 - RNA, 21 nt, Artificial Sequence
  Marburg virus siRNA sense strand
caagcauaggggaaaacgcua

SEQ ID NO: 33356 - RNA, 21 nt, Artificial Sequence
  Marburg virus siRNA sense strand
aagcauaggggaaaacgcuau

SEQ ID NO: 33357 - RNA, 21 nt, Artificial Sequence
  Marburg virus siRNA sense strand
agcauaggggaaaacgcuaua

SEQ ID NO: 33358 - RNA, 21 nt, Artificial Sequence
  Marburg virus siRNA sense strand
gcauaggggaaaacgcuauag

SEQ ID NO: 33359 - RNA, 21 nt, Artificial Sequence
  Marburg virus siRNA sense strand
cauaggggaaaacgcuauagu

SEQ ID NO: 33360 - RNA, 21 nt, Artificial Sequence
  Marburg virus siRNA sense strand
auaggggaaaacgcuauagua

SEQ ID NO: 33361 - RNA, 21 nt, Artificial Sequence
  Marburg virus siRNA sense strand
uaggggaaaacgcuauaguaa

SEQ ID NO: 33362 - RNA, 21 nt, Artificial Sequence
  Marburg virus siRNA sense strand
aggggaaaacgcuauaguaag

SEQ ID NO: 33363 - RNA, 21 nt, Artificial Sequence
  Marburg virus siRNA sense strand
ggggaaaacgcuauaguaagg

SEQ ID NO: 33364 - RNA, 21 nt, Artificial Sequence
  Marburg virus siRNA sense strand
gggaaaacgcuauaguaaggg

SEQ ID NO: 33365 - RNA, 21 nt, Artificial Sequence
  Marburg virus siRNA sense strand
ggaaaacgcuauaguaagggg

SEQ ID NO: 33366 - RNA, 21 nt, Artificial Sequence
  Marburg virus siRNA sense strand
gaaaacgcuauaguaaggggu

SEQ ID NO: 33367 - RNA, 21 nt, Artificial Sequence
  Marburg virus siRNA sense strand
aaaacgcuauaguaaggggug

SEQ ID NO: 33368 - RNA, 21 nt, Artificial Sequence
  Marburg virus siRNA sense strand
aaacgcuauaguaaggggugc

SEQ ID NO: 33369 - RNA, 21 nt, Artificial Sequence
  Marburg virus siRNA sense strand
aacgcuauaguaaggggugca

SEQ ID NO: 33370 - RNA, 21 nt, Artificial Sequence
  Marburg virus siRNA sense strand
acgcuauaguaaggggugcaa

SEQ ID NO: 33371 - RNA, 21 nt, Artificial Sequence
  Marburg virus siRNA sense strand
cgcuauaguaaggggugcaag

SEQ ID NO: 33372 - RNA, 21 nt, Artificial Sequence
  Marburg virus siRNA sense strand
gcuauaguaaggggugcaagu

SEQ ID NO: 33373 - RNA, 21 nt, Artificial Sequence
  Marburg virus siRNA sense strand
cuauaguaaggggugcaaguu

SEQ ID NO: 33374 - RNA, 21 nt, Artificial Sequence
  Marburg virus siRNA sense strand
uauaguaaggggugcaaguuu

SEQ ID NO: 33375 - RNA, 21 nt, Artificial Sequence
  Marburg virus siRNA sense strand
auaguaaggggugcaaguuuu

SEQ ID NO: 33376 - RNA, 21 nt, Artificial Sequence
  Marburg virus siRNA sense strand
uaguaaggggugcaaguuuug

SEQ ID NO: 33377 - RNA, 21 nt, Artificial Sequence
  Marburg virus siRNA sense strand
aguaaggggugcaaguuuugu

SEQ ID NO: 33378 - RNA, 21 nt, Artificial Sequence
  Marburg virus siRNA sense strand
guaaggggugcaaguuuuguu

SEQ ID NO: 33379 - RNA, 21 nt, Artificial Sequence
  Marburg virus siRNA sense strand
uaaggggugcaaguuuuguua

SEQ ID NO: 33380 - RNA, 21 nt, Artificial Sequence
  Marburg virus siRNA sense strand
aaggggugcaaguuuuguuac

SEQ ID NO: 33381 - RNA, 21 nt, Artificial Sequence
  Marburg virus siRNA sense strand
aggggugcaaguuuuguuacu

SEQ ID NO: 33382 - RNA, 21 nt, Artificial Sequence
  Marburg virus siRNA sense strand
ggggugcaaguuuuguuacug

SEQ ID NO: 33383 - RNA, 21 nt, Artificial Sequence
  Marburg virus siRNA sense strand
gggugcaaguuuuguuacuga

SEQ ID NO: 33384 - RNA, 21 nt, Artificial Sequence
  Marburg virus siRNA sense strand
ggugcaaguuuuguuacugau

SEQ ID NO: 33385 - RNA, 21 nt, Artificial Sequence
  Marburg virus siRNA sense strand
gugcaaguuuuguuacugauc

SEQ ID NO: 33386 - RNA, 21 nt, Artificial Sequence
  Marburg virus siRNA sense strand
ugcaaguuuuguuacugaucu

SEQ ID NO: 33387 - RNA, 21 nt, Artificial Sequence
  Marburg virus siRNA sense strand
gcaaguuuuguuacugaucuu

SEQ ID NO: 33388 - RNA, 21 nt, Artificial Sequence
  Marburg virus siRNA sense strand
caaguuuuguuacugaucuug

SEQ ID NO: 33389 - RNA, 21 nt, Artificial Sequence
  Marburg virus siRNA sense strand
aaguuuuguuacugaucuuga

SEQ ID NO: 33390 - RNA, 21 nt, Artificial Sequence
  Marburg virus siRNA sense strand
aguuuuguuacugaucuugag

SEQ ID NO: 33391 - RNA, 21 nt, Artificial Sequence
  Marburg virus siRNA sense strand
guuuuguuacugaucuugaga

SEQ ID NO: 33392 - RNA, 21 nt, Artificial Sequence
  Marburg virus siRNA sense strand
uuuuguuacugaucuugagaa

SEQ ID NO: 33393 - RNA, 21 nt, Artificial Sequence
  Marburg virus siRNA sense strand
uuuguuacugaucuugagaaa

SEQ ID NO: 33394 - RNA, 21 nt, Artificial Sequence
  Marburg virus siRNA sense strand
uuguuacugaucuugagaaau

SEQ ID NO: 33395 - RNA, 21 nt, Artificial Sequence
  Marburg virus siRNA sense strand
uguuacugaucuugagaaaua

SEQ ID NO: 33396 - RNA, 21 nt, Artificial Sequence
  Marburg virus siRNA sense strand
guuacugaucuugagaaauac

SEQ ID NO: 33397 - RNA, 21 nt, Artificial Sequence
  Marburg virus siRNA sense strand
uuacugaucuugagaaauaca

SEQ ID NO: 33398 - RNA, 21 nt, Artificial Sequence
  Marburg virus siRNA sense strand
uacugaucuugagaaauacaa

SEQ ID NO: 33399 - RNA, 21 nt, Artificial Sequence
  Marburg virus siRNA sense strand
acugaucuugagaaauacaac

SEQ ID NO: 33400 - RNA, 21 nt, Artificial Sequence
  Marburg virus siRNA sense strand
cugaucuugagaaauacaacc

SEQ ID NO: 33401 - RNA, 21 nt, Artificial Sequence
  Marburg virus siRNA sense strand
ugaucuugagaaauacaaccu

SEQ ID NO: 33402 - RNA, 21 nt, Artificial Sequence
  Marburg virus siRNA sense strand
gaucuugagaaauacaaccuu

SEQ ID NO: 33403 - RNA, 21 nt, Artificial Sequence
  Marburg virus siRNA sense strand
aucuugagaaauacaaccuug

SEQ ID NO: 33404 - RNA, 21 nt, Artificial Sequence
  Marburg virus siRNA sense strand
ucuugagaaauacaaccuugc

SEQ ID NO: 33405 - RNA, 21 nt, Artificial Sequence
  Marburg virus siRNA sense strand
cuugagaaauacaaccuugcc

SEQ ID NO: 33406 - RNA, 21 nt, Artificial Sequence
  Marburg virus siRNA sense strand
uugagaaauacaaccuugccu

SEQ ID NO: 33407 - RNA, 21 nt, Artificial Sequence
  Marburg virus siRNA sense strand
ugagaaauacaaccuugccuu

SEQ ID NO: 33408 - RNA, 21 nt, Artificial Sequence
  Marburg virus siRNA sense strand
gagaaauacaaccuugccuuc

SEQ ID NO: 33409 - RNA, 21 nt, Artificial Sequence
  Marburg virus siRNA sense strand
agaaauacaaccuugccuucc

SEQ ID NO: 33410 - RNA, 21 nt, Artificial Sequence
  Marburg virus siRNA sense strand
gaaauacaaccuugccuuccg

SEQ ID NO: 33411 - RNA, 21 nt, Artificial Sequence
  Marburg virus siRNA sense strand
aaauacaaccuugccuuccga

SEQ ID NO: 33412 - RNA, 21 nt, Artificial Sequence
  Marburg virus siRNA sense strand
aauacaaccuugccuuccgau

SEQ ID NO: 33413 - RNA, 21 nt, Artificial Sequence
  Marburg virus siRNA sense strand
auacaaccuugccuuccgaua

SEQ ID NO: 33414 - RNA, 21 nt, Artificial Sequence
  Marburg virus siRNA sense strand
uacaaccuugccuuccgauau

SEQ ID NO: 33415 - RNA, 21 nt, Artificial Sequence
  Marburg virus siRNA sense strand
acaaccuugccuuccgauaug

SEQ ID NO: 33416 - RNA, 21 nt, Artificial Sequence
  Marburg virus siRNA sense strand
caaccuugccuuccgauauga

SEQ ID NO: 33417 - RNA, 21 nt, Artificial Sequence
  Marburg virus siRNA sense strand
aaccuugccuuccgauaugaa

SEQ ID NO: 33418 - RNA, 21 nt, Artificial Sequence
  Marburg virus siRNA sense strand
accuugccuuccgauaugaau

SEQ ID NO: 33419 - RNA, 21 nt, Artificial Sequence
  Marburg virus siRNA sense strand
ccuugccuuccgauaugaauu

SEQ ID NO: 33420 - RNA, 21 nt, Artificial Sequence
  Marburg virus siRNA sense strand
cuugccuuccgauaugaauuu

SEQ ID NO: 33421 - RNA, 21 nt, Artificial Sequence
  Marburg virus siRNA sense strand
uugccuuccgauaugaauuua

SEQ ID NO: 33422 - RNA, 21 nt, Artificial Sequence
  Marburg virus siRNA sense strand
ugccuuccgauaugaauuuac

SEQ ID NO: 33423 - RNA, 21 nt, Artificial Sequence
  Marburg virus siRNA sense strand
gccuuccgauaugaauuuaca

SEQ ID NO: 33424 - RNA, 21 nt, Artificial Sequence
  Marburg virus siRNA sense strand
ccuuccgauaugaauuuacac

SEQ ID NO: 33425 - RNA, 21 nt, Artificial Sequence
  Marburg virus siRNA sense strand
cuuccgauaugaauuuacacg

SEQ ID NO: 33426 - RNA, 21 nt, Artificial Sequence
  Marburg virus siRNA sense strand
uuccgauaugaauuuacacga

SEQ ID NO: 33427 - RNA, 21 nt, Artificial Sequence
  Marburg virus siRNA sense strand
uccgauaugaauuuacacgac

SEQ ID NO: 33428 - RNA, 21 nt, Artificial Sequence
  Marburg virus siRNA sense strand
ccgauaugaauuuacacgaca

SEQ ID NO: 33429 - RNA, 21 nt, Artificial Sequence
  Marburg virus siRNA sense strand
cgauaugaauuuacacgacau

SEQ ID NO: 33430 - RNA, 21 nt, Artificial Sequence
  Marburg virus siRNA sense strand
gauaugaauuuacacgacauu

SEQ ID NO: 33431 - RNA, 21 nt, Artificial Sequence
  Marburg virus siRNA sense strand
auaugaauuuacacgacauuu

SEQ ID NO: 33432 - RNA, 21 nt, Artificial Sequence
  Marburg virus siRNA sense strand
uaugaauuuacacgacauuuc

SEQ ID NO: 33433 - RNA, 21 nt, Artificial Sequence
  Marburg virus siRNA sense strand
augaauuuacacgacauuuca

SEQ ID NO: 33434 - RNA, 21 nt, Artificial Sequence
  Marburg virus siRNA sense strand
ugaauuuacacgacauuucau

SEQ ID NO: 33435 - RNA, 21 nt, Artificial Sequence
  Marburg virus siRNA sense strand
gaauuuacacgacauuucaua

SEQ ID NO: 33436 - RNA, 21 nt, Artificial Sequence
  Marburg virus siRNA sense strand
aauuuacacgacauuucauag

SEQ ID NO: 33437 - RNA, 21 nt, Artificial Sequence
  Marburg virus siRNA sense strand
auuuacacgacauuucauaga

SEQ ID NO: 33438 - RNA, 21 nt, Artificial Sequence
  Marburg virus siRNA sense strand
uuuacacgacauuucauagac

SEQ ID NO: 33439 - RNA, 21 nt, Artificial Sequence
  Marburg virus siRNA sense strand
uuacacgacauuucauagacu

SEQ ID NO: 33440 - RNA, 21 nt, Artificial Sequence
  Marburg virus siRNA sense strand
uacacgacauuucauagacua

SEQ ID NO: 33441 - RNA, 21 nt, Artificial Sequence
  Marburg virus siRNA sense strand
acacgacauuucauagacuac

SEQ ID NO: 33442 - RNA, 21 nt, Artificial Sequence
  Marburg virus siRNA sense strand
cacgacauuucauagacuacu

SEQ ID NO: 33443 - RNA, 21 nt, Artificial Sequence
  Marburg virus siRNA sense strand
acgacauuucauagacuacug

SEQ ID NO: 33444 - RNA, 21 nt, Artificial Sequence
  Marburg virus siRNA sense strand
cgacauuucauagacuacugu

SEQ ID NO: 33445 - RNA, 21 nt, Artificial Sequence
  Marburg virus siRNA sense strand
gacauuucauagacuacugua

SEQ ID NO: 33446 - RNA, 21 nt, Artificial Sequence
  Marburg virus siRNA sense strand
acauuucauagacuacuguaa

SEQ ID NO: 33447 - RNA, 21 nt, Artificial Sequence
  Marburg virus siRNA sense strand
cauuucauagacuacuguaau

SEQ ID NO: 33448 - RNA, 21 nt, Artificial Sequence
  Marburg virus siRNA sense strand
auuucauagacuacuguaauc

SEQ ID NO: 33449 - RNA, 21 nt, Artificial Sequence
  Marburg virus siRNA sense strand
uuucauagacuacuguaaucg

SEQ ID NO: 33450 - RNA, 21 nt, Artificial Sequence
  Marburg virus siRNA sense strand
uucauagacuacuguaaucga

SEQ ID NO: 33451 - RNA, 21 nt, Artificial Sequence
  Marburg virus siRNA sense strand
ucauagacuacuguaaucgau

SEQ ID NO: 33452 - RNA, 21 nt, Artificial Sequence
  Marburg virus siRNA sense strand
cauagacuacuguaaucgaug

SEQ ID NO: 33453 - RNA, 21 nt, Artificial Sequence
  Marburg virus siRNA sense strand
auagacuacuguaaucgaugu

SEQ ID NO: 33454 - RNA, 21 nt, Artificial Sequence
  Marburg virus siRNA sense strand
uagacuacuguaaucgauguu

SEQ ID NO: 33455 - RNA, 21 nt, Artificial Sequence
  Marburg virus siRNA sense strand
agacuacuguaaucgauguua

SEQ ID NO: 33456 - RNA, 21 nt, Artificial Sequence
  Marburg virus siRNA sense strand
gacuacuguaaucgauguuau

SEQ ID NO: 33457 - RNA, 21 nt, Artificial Sequence
  Marburg virus siRNA sense strand
acuacuguaaucgauguuaug

SEQ ID NO: 33458 - RNA, 21 nt, Artificial Sequence
  Marburg virus siRNA sense strand
cuacuguaaucgauguuaugg

SEQ ID NO: 33459 - RNA, 21 nt, Artificial Sequence
  Marburg virus siRNA sense strand
uacuguaaucgauguuauggu

SEQ ID NO: 33460 - RNA, 21 nt, Artificial Sequence
  Marburg virus siRNA sense strand
acuguaaucgauguuauggug

SEQ ID NO: 33461 - RNA, 21 nt, Artificial Sequence
  Marburg virus siRNA sense strand
cuguaaucgauguuauggugu

SEQ ID NO: 33462 - RNA, 21 nt, Artificial Sequence
  Marburg virus siRNA sense strand
uguaaucgauguuauggugug

SEQ ID NO: 33463 - RNA, 21 nt, Artificial Sequence
  Marburg virus siRNA sense strand
guaaucgauguuaugguguga

SEQ ID NO: 33464 - RNA, 21 nt, Artificial Sequence
  Marburg virus siRNA sense strand
uaaucgauguuauggugugaa

SEQ ID NO: 33465 - RNA, 21 nt, Artificial Sequence
  Marburg virus siRNA sense strand
aaucgauguuauggugugaag

SEQ ID NO: 33466 - RNA, 21 nt, Artificial Sequence
  Marburg virus siRNA sense strand
aucgauguuauggugugaaga

SEQ ID NO: 33467 - RNA, 21 nt, Artificial Sequence
  Marburg virus siRNA sense strand
ucgauguuauggugugaagaa

SEQ ID NO: 33468 - RNA, 21 nt, Artificial Sequence
  Marburg virus siRNA sense strand
cgauguuauggugugaagaau

SEQ ID NO: 33469 - RNA, 21 nt, Artificial Sequence
  Marburg virus siRNA sense strand
gauguuauggugugaagaauu

SEQ ID NO: 33470 - RNA, 21 nt, Artificial Sequence
  Marburg virus siRNA sense strand
auguuauggugugaagaauuu

SEQ ID NO: 33471 - RNA, 21 nt, Artificial Sequence
  Marburg virus siRNA sense strand
uguuauggugugaagaauuua

SEQ ID NO: 33472 - RNA, 21 nt, Artificial Sequence
  Marburg virus siRNA sense strand
guuauggugugaagaauuuau

SEQ ID NO: 33473 - RNA, 21 nt, Artificial Sequence
  Marburg virus siRNA sense strand
uuauggugugaagaauuuauu

SEQ ID NO: 33474 - RNA, 21 nt, Artificial Sequence
  Marburg virus siRNA sense strand
uauggugugaagaauuuauuc

SEQ ID NO: 33475 - RNA, 21 nt, Artificial Sequence
  Marburg virus siRNA sense strand
auggugugaagaauuuauucg

SEQ ID NO: 33476 - RNA, 21 nt, Artificial Sequence
  Marburg virus siRNA sense strand
uggugugaagaauuuauucga

SEQ ID NO: 33477 - RNA, 21 nt, Artificial Sequence
  Marburg virus siRNA sense strand
ggugugaagaauuuauucgau

SEQ ID NO: 33478 - RNA, 21 nt, Artificial Sequence
  Marburg virus siRNA sense strand
gugugaagaauuuauucgauu

SEQ ID NO: 33479 - RNA, 21 nt, Artificial Sequence
  Marburg virus siRNA sense strand
ugugaagaauuuauucgauug

SEQ ID NO: 33480 - RNA, 21 nt, Artificial Sequence
  Marburg virus siRNA sense strand
gugaagaauuuauucgauugg

SEQ ID NO: 33481 - RNA, 21 nt, Artificial Sequence
  Marburg virus siRNA sense strand
ugaagaauuuauucgauugga

SEQ ID NO: 33482 - RNA, 21 nt, Artificial Sequence
  Marburg virus siRNA sense strand
gaagaauuuauucgauuggau

SEQ ID NO: 33483 - RNA, 21 nt, Artificial Sequence
  Marburg virus siRNA sense strand
aagaauuuauucgauuggaug

SEQ ID NO: 33484 - RNA, 21 nt, Artificial Sequence
  Marburg virus siRNA sense strand
agaauuuauucgauuggaugc

SEQ ID NO: 33485 - RNA, 21 nt, Artificial Sequence
  Marburg virus siRNA sense strand
gaauuuauucgauuggaugca

SEQ ID NO: 33486 - RNA, 21 nt, Artificial Sequence
  Marburg virus siRNA sense strand
aauuuauucgauuggaugcac

SEQ ID NO: 33487 - RNA, 21 nt, Artificial Sequence
  Marburg virus siRNA sense strand
auuuauucgauuggaugcacu

SEQ ID NO: 33488 - RNA, 21 nt, Artificial Sequence
  Marburg virus siRNA sense strand
uuuauucgauuggaugcacuu

SEQ ID NO: 33489 - RNA, 21 nt, Artificial Sequence
  Marburg virus siRNA sense strand
uuauucgauuggaugcacuuu

SEQ ID NO: 33490 - RNA, 21 nt, Artificial Sequence
  Marburg virus siRNA sense strand
uauucgauuggaugcacuuuu

SEQ ID NO: 33491 - RNA, 21 nt, Artificial Sequence
  Marburg virus siRNA sense strand
auucgauuggaugcacuuuuu

SEQ ID NO: 33492 - RNA, 21 nt, Artificial Sequence
  Marburg virus siRNA sense strand
uucgauuggaugcacuuuuua

SEQ ID NO: 33493 - RNA, 21 nt, Artificial Sequence
  Marburg virus siRNA sense strand
ucgauuggaugcacuuuuuaa

SEQ ID NO: 33494 - RNA, 21 nt, Artificial Sequence
  Marburg virus siRNA sense strand
cgauuggaugcacuuuuuaau

SEQ ID NO: 33495 - RNA, 21 nt, Artificial Sequence
  Marburg virus siRNA sense strand
gauuggaugcacuuuuuaaua

SEQ ID NO: 33496 - RNA, 21 nt, Artificial Sequence
  Marburg virus siRNA sense strand
auuggaugcacuuuuuaauac

SEQ ID NO: 33497 - RNA, 21 nt, Artificial Sequence
  Marburg virus siRNA sense strand
uuggaugcacuuuuuaauacc

SEQ ID NO: 33498 - RNA, 21 nt, Artificial Sequence
  Marburg virus siRNA sense strand
uggaugcacuuuuuaauacca

SEQ ID NO: 33499 - RNA, 21 nt, Artificial Sequence
  Marburg virus siRNA sense strand
ggaugcacuuuuuaauaccac

SEQ ID NO: 33500 - RNA, 21 nt, Artificial Sequence
  Marburg virus siRNA sense strand
gaugcacuuuuuaauaccacu

SEQ ID NO: 33501 - RNA, 21 nt, Artificial Sequence
  Marburg virus siRNA sense strand
augcacuuuuuaauaccacua

SEQ ID NO: 33502 - RNA, 21 nt, Artificial Sequence
  Marburg virus siRNA sense strand
ugcacuuuuuaauaccacuau

SEQ ID NO: 33503 - RNA, 21 nt, Artificial Sequence
  Marburg virus siRNA sense strand
gcacuuuuuaauaccacuaug

SEQ ID NO: 33504 - RNA, 21 nt, Artificial Sequence
  Marburg virus siRNA sense strand
cacuuuuuaauaccacuaugu

SEQ ID NO: 33505 - RNA, 21 nt, Artificial Sequence
  Marburg virus siRNA sense strand
acuuuuuaauaccacuauguu

SEQ ID NO: 33506 - RNA, 21 nt, Artificial Sequence
  Marburg virus siRNA sense strand
cuuuuuaauaccacuauguua

SEQ ID NO: 33507 - RNA, 21 nt, Artificial Sequence
  Marburg virus siRNA sense strand
uuuuuaauaccacuauguuau

SEQ ID NO: 33508 - RNA, 21 nt, Artificial Sequence
  Marburg virus siRNA sense strand
uuuuaauaccacuauguuaua

SEQ ID NO: 33509 - RNA, 21 nt, Artificial Sequence
  Marburg virus siRNA sense strand
uuuaauaccacuauguuauau

SEQ ID NO: 33510 - RNA, 21 nt, Artificial Sequence
  Marburg virus siRNA sense strand
uuaauaccacuauguuauaug

SEQ ID NO: 33511 - RNA, 21 nt, Artificial Sequence
  Marburg virus siRNA sense strand
uaauaccacuauguuauaugc

SEQ ID NO: 33512 - RNA, 21 nt, Artificial Sequence
  Marburg virus siRNA sense strand
aauaccacuauguuauaugca

SEQ ID NO: 33513 - RNA, 21 nt, Artificial Sequence
  Marburg virus siRNA sense strand
auaccacuauguuauaugcau

SEQ ID NO: 33514 - RNA, 21 nt, Artificial Sequence
  Marburg virus siRNA sense strand
uaccacuauguuauaugcaug

SEQ ID NO: 33515 - RNA, 21 nt, Artificial Sequence
  Marburg virus siRNA sense strand
accacuauguuauaugcaugu

SEQ ID NO: 33516 - RNA, 21 nt, Artificial Sequence
  Marburg virus siRNA sense strand
ccacuauguuauaugcauguc

SEQ ID NO: 33517 - RNA, 21 nt, Artificial Sequence
  Marburg virus siRNA sense strand
cacuauguuauaugcauguca

SEQ ID NO: 33518 - RNA, 21 nt, Artificial Sequence
  Marburg virus siRNA sense strand
acuauguuauaugcaugucag

SEQ ID NO: 33519 - RNA, 21 nt, Artificial Sequence
  Marburg virus siRNA sense strand
cuauguuauaugcaugucagu

SEQ ID NO: 33520 - RNA, 21 nt, Artificial Sequence
  Marburg virus siRNA sense strand
uauguuauaugcaugucagug

SEQ ID NO: 33521 - RNA, 21 nt, Artificial Sequence
  Marburg virus siRNA sense strand
auguuauaugcaugucaguga

SEQ ID NO: 33522 - RNA, 21 nt, Artificial Sequence
  Marburg virus siRNA sense strand
uguuauaugcaugucagugau

SEQ ID NO: 33523 - RNA, 21 nt, Artificial Sequence
  Marburg virus siRNA sense strand
guuauaugcaugucagugauu

SEQ ID NO: 33524 - RNA, 21 nt, Artificial Sequence
  Marburg virus siRNA sense strand
uuauaugcaugucagugauuu

SEQ ID NO: 33525 - RNA, 21 nt, Artificial Sequence
  Marburg virus siRNA sense strand
uauaugcaugucagugauuuu

SEQ ID NO: 33526 - RNA, 21 nt, Artificial Sequence
  Marburg virus siRNA sense strand
auaugcaugucagugauuuuu

SEQ ID NO: 33527 - RNA, 21 nt, Artificial Sequence
  Marburg virus siRNA sense strand
uaugcaugucagugauuuuua

SEQ ID NO: 33528 - RNA, 21 nt, Artificial Sequence
  Marburg virus siRNA sense strand
augcaugucagugauuuuuau

SEQ ID NO: 33529 - RNA, 21 nt, Artificial Sequence
  Marburg virus siRNA sense strand
ugcaugucagugauuuuuaua

SEQ ID NO: 33530 - RNA, 21 nt, Artificial Sequence
  Marburg virus siRNA sense strand
gcaugucagugauuuuuauag

SEQ ID NO: 33531 - RNA, 21 nt, Artificial Sequence
  Marburg virus siRNA sense strand
caugucagugauuuuuauagc

SEQ ID NO: 33532 - RNA, 21 nt, Artificial Sequence
  Marburg virus siRNA sense strand
augucagugauuuuuauagcc

SEQ ID NO: 33533 - RNA, 21 nt, Artificial Sequence
  Marburg virus siRNA sense strand
ugucagugauuuuuauagccc

SEQ ID NO: 33534 - RNA, 21 nt, Artificial Sequence
  Marburg virus siRNA sense strand
gucagugauuuuuauagccca

SEQ ID NO: 33535 - RNA, 21 nt, Artificial Sequence
  Marburg virus siRNA sense strand
ucagugauuuuuauagcccac

SEQ ID NO: 33536 - RNA, 21 nt, Artificial Sequence
  Marburg virus siRNA sense strand
cagugauuuuuauagcccacc

SEQ ID NO: 33537 - RNA, 21 nt, Artificial Sequence
  Marburg virus siRNA sense strand
agugauuuuuauagcccacca

SEQ ID NO: 33538 - RNA, 21 nt, Artificial Sequence
  Marburg virus siRNA sense strand
gugauuuuuauagcccaccac

SEQ ID NO: 33539 - RNA, 21 nt, Artificial Sequence
  Marburg virus siRNA sense strand
ugauuuuuauagcccaccaca

SEQ ID NO: 33540 - RNA, 21 nt, Artificial Sequence
  Marburg virus siRNA sense strand
gauuuuuauagcccaccacau

SEQ ID NO: 33541 - RNA, 21 nt, Artificial Sequence
  Marburg virus siRNA sense strand
auuuuuauagcccaccacauu

SEQ ID NO: 33542 - RNA, 21 nt, Artificial Sequence
  Marburg virus siRNA sense strand
uuuuuauagcccaccacauug

SEQ ID NO: 33543 - RNA, 21 nt, Artificial Sequence
  Marburg virus siRNA sense strand
uuuuauagcccaccacauugc

SEQ ID NO: 33544 - RNA, 21 nt, Artificial Sequence
  Marburg virus siRNA sense strand
uuuauagcccaccacauugcg

SEQ ID NO: 33545 - RNA, 21 nt, Artificial Sequence
  Marburg virus siRNA sense strand
uuauagcccaccacauugcgu

SEQ ID NO: 33546 - RNA, 21 nt, Artificial Sequence
  Marburg virus siRNA sense strand
uauagcccaccacauugcgua

SEQ ID NO: 33547 - RNA, 21 nt, Artificial Sequence
  Marburg virus siRNA sense strand
auagcccaccacauugcguaa

SEQ ID NO: 33548 - RNA, 21 nt, Artificial Sequence
  Marburg virus siRNA sense strand
uagcccaccacauugcguaac

SEQ ID NO: 33549 - RNA, 21 nt, Artificial Sequence
  Marburg virus siRNA sense strand
agcccaccacauugcguaaca

SEQ ID NO: 33550 - RNA, 21 nt, Artificial Sequence
  Marburg virus siRNA sense strand
gcccaccacauugcguaacag

SEQ ID NO: 33551 - RNA, 21 nt, Artificial Sequence
  Marburg virus siRNA sense strand
cccaccacauugcguaacaga

SEQ ID NO: 33552 - RNA, 21 nt, Artificial Sequence
  Marburg virus siRNA sense strand
ccaccacauugcguaacagaa

SEQ ID NO: 33553 - RNA, 21 nt, Artificial Sequence
  Marburg virus siRNA sense strand
caccacauugcguaacagaag

SEQ ID NO: 33554 - RNA, 21 nt, Artificial Sequence
  Marburg virus siRNA sense strand
accacauugcguaacagaaga

SEQ ID NO: 33555 - RNA, 21 nt, Artificial Sequence
  Marburg virus siRNA sense strand
ccacauugcguaacagaagau

SEQ ID NO: 33556 - RNA, 21 nt, Artificial Sequence
  Marburg virus siRNA sense strand
cacauugcguaacagaagaua

SEQ ID NO: 33557 - RNA, 21 nt, Artificial Sequence
  Marburg virus siRNA sense strand
acauugcguaacagaagauaa

SEQ ID NO: 33558 - RNA, 21 nt, Artificial Sequence
  Marburg virus siRNA sense strand
cauugcguaacagaagauaac

SEQ ID NO: 33559 - RNA, 21 nt, Artificial Sequence
  Marburg virus siRNA sense strand
auugcguaacagaagauaacc

SEQ ID NO: 33560 - RNA, 21 nt, Artificial Sequence
  Marburg virus siRNA sense strand
uugcguaacagaagauaaccg

SEQ ID NO: 33561 - RNA, 21 nt, Artificial Sequence
  Marburg virus siRNA sense strand
ugcguaacagaagauaaccga

SEQ ID NO: 33562 - RNA, 21 nt, Artificial Sequence
  Marburg virus siRNA sense strand
gcguaacagaagauaaccgaa

SEQ ID NO: 33563 - RNA, 21 nt, Artificial Sequence
  Marburg virus siRNA sense strand
cguaacagaagauaaccgaaa

SEQ ID NO: 33564 - RNA, 21 nt, Artificial Sequence
  Marburg virus siRNA sense strand
guaacagaagauaaccgaaau

SEQ ID NO: 33565 - RNA, 21 nt, Artificial Sequence
  Marburg virus siRNA sense strand
uaacagaagauaaccgaaaua

SEQ ID NO: 33566 - RNA, 21 nt, Artificial Sequence
  Marburg virus siRNA sense strand
aacagaagauaaccgaaauaa

SEQ ID NO: 33567 - RNA, 21 nt, Artificial Sequence
  Marburg virus siRNA sense strand
acagaagauaaccgaaauaac

SEQ ID NO: 33568 - RNA, 21 nt, Artificial Sequence
  Marburg virus siRNA sense strand
cagaagauaaccgaaauaacc

SEQ ID NO: 33569 - RNA, 21 nt, Artificial Sequence
  Marburg virus siRNA sense strand
agaagauaaccgaaauaaccc

SEQ ID NO: 33570 - RNA, 21 nt, Artificial Sequence
  Marburg virus siRNA sense strand
gaagauaaccgaaauaaccca

SEQ ID NO: 33571 - RNA, 21 nt, Artificial Sequence
  Marburg virus siRNA sense strand
aagauaaccgaaauaacccac

SEQ ID NO: 33572 - RNA, 21 nt, Artificial Sequence
  Marburg virus siRNA sense strand
agauaaccgaaauaacccacc

SEQ ID NO: 33573 - RNA, 21 nt, Artificial Sequence
  Marburg virus siRNA sense strand
gauaaccgaaauaacccaccg

SEQ ID NO: 33574 - RNA, 21 nt, Artificial Sequence
  Marburg virus siRNA sense strand
auaaccgaaauaacccaccgg

SEQ ID NO: 33575 - RNA, 21 nt, Artificial Sequence
  Marburg virus siRNA sense strand
uaaccgaaauaacccaccgga

SEQ ID NO: 33576 - RNA, 21 nt, Artificial Sequence
  Marburg virus siRNA sense strand
aaccgaaauaacccaccggau

SEQ ID NO: 33577 - RNA, 21 nt, Artificial Sequence
  Marburg virus siRNA sense strand
accgaaauaacccaccggauu

SEQ ID NO: 33578 - RNA, 21 nt, Artificial Sequence
  Marburg virus siRNA sense strand
ccgaaauaacccaccggauug

SEQ ID NO: 33579 - RNA, 21 nt, Artificial Sequence
  Marburg virus siRNA sense strand
cgaaauaacccaccggauugu

SEQ ID NO: 33580 - RNA, 21 nt, Artificial Sequence
  Marburg virus siRNA sense strand
gaaauaacccaccggauugug

SEQ ID NO: 33581 - RNA, 21 nt, Artificial Sequence
  Marburg virus siRNA sense strand
aaauaacccaccggauugugc

SEQ ID NO: 33582 - RNA, 21 nt, Artificial Sequence
  Marburg virus siRNA sense strand
aauaacccaccggauugugcu

SEQ ID NO: 33583 - RNA, 21 nt, Artificial Sequence
  Marburg virus siRNA sense strand
auaacccaccggauugugcua

SEQ ID NO: 33584 - RNA, 21 nt, Artificial Sequence
  Marburg virus siRNA sense strand
uaacccaccggauugugcuaa

SEQ ID NO: 33585 - RNA, 21 nt, Artificial Sequence
  Marburg virus siRNA sense strand
aacccaccggauugugcuaau

SEQ ID NO: 33586 - RNA, 21 nt, Artificial Sequence
  Marburg virus siRNA sense strand
acccaccggauugugcuaaug

SEQ ID NO: 33587 - RNA, 21 nt, Artificial Sequence
  Marburg virus siRNA sense strand
cccaccggauugugcuaaugc

SEQ ID NO: 33588 - RNA, 21 nt, Artificial Sequence
  Marburg virus siRNA sense strand
ccaccggauugugcuaaugcu

SEQ ID NO: 33589 - RNA, 21 nt, Artificial Sequence
  Marburg virus siRNA sense strand
caccggauugugcuaaugcuu

SEQ ID NO: 33590 - RNA, 21 nt, Artificial Sequence
  Marburg virus siRNA sense strand
accggauugugcuaaugcuua

SEQ ID NO: 33591 - RNA, 21 nt, Artificial Sequence
  Marburg virus siRNA sense strand
ccggauugugcuaaugcuuau

SEQ ID NO: 33592 - RNA, 21 nt, Artificial Sequence
  Marburg virus siRNA sense strand
cggauugugcuaaugcuuauc

SEQ ID NO: 33593 - RNA, 21 nt, Artificial Sequence
  Marburg virus siRNA sense strand
ggauugugcuaaugcuuauca

SEQ ID NO: 33594 - RNA, 21 nt, Artificial Sequence
  Marburg virus siRNA sense strand
gauugugcuaaugcuuaucau

SEQ ID NO: 33595 - RNA, 21 nt, Artificial Sequence
  Marburg virus siRNA sense strand
auugugcuaaugcuuaucauu

SEQ ID NO: 33596 - RNA, 21 nt, Artificial Sequence
  Marburg virus siRNA sense strand
uugugcuaaugcuuaucauua

SEQ ID NO: 33597 - RNA, 21 nt, Artificial Sequence
  Marburg virus siRNA sense strand
ugugcuaaugcuuaucauuau

SEQ ID NO: 33598 - RNA, 21 nt, Artificial Sequence
  Marburg virus siRNA sense strand
gugcuaaugcuuaucauuauc

SEQ ID NO: 33599 - RNA, 21 nt, Artificial Sequence
  Marburg virus siRNA sense strand
ugcuaaugcuuaucauuauca

SEQ ID NO: 33600 - RNA, 21 nt, Artificial Sequence
  Marburg virus siRNA sense strand
gcuaaugcuuaucauuaucac

SEQ ID NO: 33601 - RNA, 21 nt, Artificial Sequence
  Marburg virus siRNA sense strand
cuaaugcuuaucauuaucacu

SEQ ID NO: 33602 - RNA, 21 nt, Artificial Sequence
  Marburg virus siRNA sense strand
uaaugcuuaucauuaucacuu

SEQ ID NO: 33603 - RNA, 21 nt, Artificial Sequence
  Marburg virus siRNA sense strand
aaugcuuaucauuaucacuua

SEQ ID NO: 33604 - RNA, 21 nt, Artificial Sequence
  Marburg virus siRNA sense strand
augcuuaucauuaucacuuag

SEQ ID NO: 33605 - RNA, 21 nt, Artificial Sequence
  Marburg virus siRNA sense strand
ugcuuaucauuaucacuuagg

SEQ ID NO: 33606 - RNA, 21 nt, Artificial Sequence
  Marburg virus siRNA sense strand
gcuuaucauuaucacuuaggg

SEQ ID NO: 33607 - RNA, 21 nt, Artificial Sequence
  Marburg virus siRNA sense strand
cuuaucauuaucacuuagggg

SEQ ID NO: 33608 - RNA, 21 nt, Artificial Sequence
  Marburg virus siRNA sense strand
uuaucauuaucacuuaggggg

SEQ ID NO: 33609 - RNA, 21 nt, Artificial Sequence
  Marburg virus siRNA sense strand
uaucauuaucacuuagggggu

SEQ ID NO: 33610 - RNA, 21 nt, Artificial Sequence
  Marburg virus siRNA sense strand
aucauuaucacuuagggggua

SEQ ID NO: 33611 - RNA, 21 nt, Artificial Sequence
  Marburg virus siRNA sense strand
ucauuaucacuuaggggguau

SEQ ID NO: 33612 - RNA, 21 nt, Artificial Sequence
  Marburg virus siRNA sense strand
cauuaucacuuaggggguaua

SEQ ID NO: 33613 - RNA, 21 nt, Artificial Sequence
  Marburg virus siRNA sense strand
auuaucacuuaggggguauag

SEQ ID NO: 33614 - RNA, 21 nt, Artificial Sequence
  Marburg virus siRNA sense strand
uuaucacuuaggggguauaga

SEQ ID NO: 33615 - RNA, 21 nt, Artificial Sequence
  Marburg virus siRNA sense strand
uaucacuuaggggguauagag

SEQ ID NO: 33616 - RNA, 21 nt, Artificial Sequence
  Marburg virus siRNA sense strand
aucacuuaggggguauagagg

SEQ ID NO: 33617 - RNA, 21 nt, Artificial Sequence
  Marburg virus siRNA sense strand
ucacuuaggggguauagaggg

SEQ ID NO: 33618 - RNA, 21 nt, Artificial Sequence
  Marburg virus siRNA sense strand
cacuuaggggguauagaggga

SEQ ID NO: 33619 - RNA, 21 nt, Artificial Sequence
  Marburg virus siRNA sense strand
acuuaggggguauagagggac

SEQ ID NO: 33620 - RNA, 21 nt, Artificial Sequence
  Marburg virus siRNA sense strand
cuuaggggguauagagggacu

SEQ ID NO: 33621 - RNA, 21 nt, Artificial Sequence
  Marburg virus siRNA sense strand
uuaggggguauagagggacuu

SEQ ID NO: 33622 - RNA, 21 nt, Artificial Sequence
  Marburg virus siRNA sense strand
uaggggguauagagggacuuc

SEQ ID NO: 33623 - RNA, 21 nt, Artificial Sequence
  Marburg virus siRNA sense strand
aggggguauagagggacuuca

SEQ ID NO: 33624 - RNA, 21 nt, Artificial Sequence
  Marburg virus siRNA sense strand
ggggguauagagggacuucaa

SEQ ID NO: 33625 - RNA, 21 nt, Artificial Sequence
  Marburg virus siRNA sense strand
gggguauagagggacuucaac

SEQ ID NO: 33626 - RNA, 21 nt, Artificial Sequence
  Marburg virus siRNA sense strand
ggguauagagggacuucaaca

SEQ ID NO: 33627 - RNA, 21 nt, Artificial Sequence
  Marburg virus siRNA sense strand
gguauagagggacuucaacag

SEQ ID NO: 33628 - RNA, 21 nt, Artificial Sequence
  Marburg virus siRNA sense strand
guauagagggacuucaacaga

SEQ ID NO: 33629 - RNA, 21 nt, Artificial Sequence
  Marburg virus siRNA sense strand
uauagagggacuucaacagaa

SEQ ID NO: 33630 - RNA, 21 nt, Artificial Sequence
  Marburg virus siRNA sense strand
auagagggacuucaacagaaa

SEQ ID NO: 33631 - RNA, 21 nt, Artificial Sequence
  Marburg virus siRNA sense strand
uagagggacuucaacagaaau

SEQ ID NO: 33632 - RNA, 21 nt, Artificial Sequence
  Marburg virus siRNA sense strand
agagggacuucaacagaaauu

SEQ ID NO: 33633 - RNA, 21 nt, Artificial Sequence
  Marburg virus siRNA sense strand
gagggacuucaacagaaauug

SEQ ID NO: 33634 - RNA, 21 nt, Artificial Sequence
  Marburg virus siRNA sense strand
agggacuucaacagaaauugu

SEQ ID NO: 33635 - RNA, 21 nt, Artificial Sequence
  Marburg virus siRNA sense strand
gggacuucaacagaaauugug

SEQ ID NO: 33636 - RNA, 21 nt, Artificial Sequence
  Marburg virus siRNA sense strand
ggacuucaacagaaauugugg

SEQ ID NO: 33637 - RNA, 21 nt, Artificial Sequence
  Marburg virus siRNA sense strand
gacuucaacagaaauugugga

SEQ ID NO: 33638 - RNA, 21 nt, Artificial Sequence
  Marburg virus siRNA sense strand
acuucaacagaaauuguggac

SEQ ID NO: 33639 - RNA, 21 nt, Artificial Sequence
  Marburg virus siRNA sense strand
cuucaacagaaauuguggaca

SEQ ID NO: 33640 - RNA, 21 nt, Artificial Sequence
  Marburg virus siRNA sense strand
uucaacagaaauuguggacau

SEQ ID NO: 33641 - RNA, 21 nt, Artificial Sequence
  Marburg virus siRNA sense strand
ucaacagaaauuguggacaug

SEQ ID NO: 33642 - RNA, 21 nt, Artificial Sequence
  Marburg virus siRNA sense strand
caacagaaauuguggacaugu

SEQ ID NO: 33643 - RNA, 21 nt, Artificial Sequence
  Marburg virus siRNA sense strand
aacagaaauuguggacaugua

SEQ ID NO: 33644 - RNA, 21 nt, Artificial Sequence
  Marburg virus siRNA sense strand
acagaaauuguggacauguau

SEQ ID NO: 33645 - RNA, 21 nt, Artificial Sequence
  Marburg virus siRNA sense strand
cagaaauuguggacauguaua

SEQ ID NO: 33646 - RNA, 21 nt, Artificial Sequence
  Marburg virus siRNA sense strand
agaaauuguggacauguauau

SEQ ID NO: 33647 - RNA, 21 nt, Artificial Sequence
  Marburg virus siRNA sense strand
gaaauuguggacauguauauc

SEQ ID NO: 33648 - RNA, 21 nt, Artificial Sequence
  Marburg virus siRNA sense strand
aaauuguggacauguauauca

SEQ ID NO: 33649 - RNA, 21 nt, Artificial Sequence
  Marburg virus siRNA sense strand
aauuguggacauguauaucau

SEQ ID NO: 33650 - RNA, 21 nt, Artificial Sequence
  Marburg virus siRNA sense strand
auuguggacauguauaucaug

SEQ ID NO: 33651 - RNA, 21 nt, Artificial Sequence
  Marburg virus siRNA sense strand
uuguggacauguauaucaugu

SEQ ID NO: 33652 - RNA, 21 nt, Artificial Sequence
  Marburg virus siRNA sense strand
uguggacauguauaucaugug

SEQ ID NO: 33653 - RNA, 21 nt, Artificial Sequence
  Marburg virus siRNA sense strand
guggacauguauaucaugugc

SEQ ID NO: 33654 - RNA, 21 nt, Artificial Sequence
  Marburg virus siRNA sense strand
uggacauguauaucaugugcc

SEQ ID NO: 33655 - RNA, 21 nt, Artificial Sequence
  Marburg virus siRNA sense strand
ggacauguauaucaugugccc

SEQ ID NO: 33656 - RNA, 21 nt, Artificial Sequence
  Marburg virus siRNA sense strand
gacauguauaucaugugccca

SEQ ID NO: 33657 - RNA, 21 nt, Artificial Sequence
  Marburg virus siRNA sense strand
acauguauaucaugugcccag

SEQ ID NO: 33658 - RNA, 21 nt, Artificial Sequence
  Marburg virus siRNA sense strand
cauguauaucaugugcccaga

SEQ ID NO: 33659 - RNA, 21 nt, Artificial Sequence
  Marburg virus siRNA sense strand
auguauaucaugugcccagau

SEQ ID NO: 33660 - RNA, 21 nt, Artificial Sequence
  Marburg virus siRNA sense strand
uguauaucaugugcccagauc

SEQ ID NO: 33661 - RNA, 21 nt, Artificial Sequence
  Marburg virus siRNA sense strand
guauaucaugugcccagauca

SEQ ID NO: 33662 - RNA, 21 nt, Artificial Sequence
  Marburg virus siRNA sense strand
uauaucaugugcccagaucac

SEQ ID NO: 33663 - RNA, 21 nt, Artificial Sequence
  Marburg virus siRNA sense strand
auaucaugugcccagaucacc

SEQ ID NO: 33664 - RNA, 21 nt, Artificial Sequence
  Marburg virus siRNA sense strand
uaucaugugcccagaucaccc

SEQ ID NO: 33665 - RNA, 21 nt, Artificial Sequence
  Marburg virus siRNA sense strand
aucaugugcccagaucacccu

SEQ ID NO: 33666 - RNA, 21 nt, Artificial Sequence
  Marburg virus siRNA sense strand
ucaugugcccagaucacccuu

SEQ ID NO: 33667 - RNA, 21 nt, Artificial Sequence
  Marburg virus siRNA sense strand
caugugcccagaucacccuug

SEQ ID NO: 33668 - RNA, 21 nt, Artificial Sequence
  Marburg virus siRNA sense strand
augugcccagaucacccuugu

SEQ ID NO: 33669 - RNA, 21 nt, Artificial Sequence
  Marburg virus siRNA sense strand
ugugcccagaucacccuugua

SEQ ID NO: 33670 - RNA, 21 nt, Artificial Sequence
  Marburg virus siRNA sense strand
gugcccagaucacccuuguag

SEQ ID NO: 33671 - RNA, 21 nt, Artificial Sequence
  Marburg virus siRNA sense strand
ugcccagaucacccuuguaga

SEQ ID NO: 33672 - RNA, 21 nt, Artificial Sequence
  Marburg virus siRNA sense strand
gcccagaucacccuuguagag

SEQ ID NO: 33673 - RNA, 21 nt, Artificial Sequence
  Marburg virus siRNA sense strand
cccagaucacccuuguagagu

SEQ ID NO: 33674 - RNA, 21 nt, Artificial Sequence
  Marburg virus siRNA sense strand
ccagaucacccuuguagaguu

SEQ ID NO: 33675 - RNA, 21 nt, Artificial Sequence
  Marburg virus siRNA sense strand
cagaucacccuuguagaguua

SEQ ID NO: 33676 - RNA, 21 nt, Artificial Sequence
  Marburg virus siRNA sense strand
agaucacccuuguagaguuaa

SEQ ID NO: 33677 - RNA, 21 nt, Artificial Sequence
  Marburg virus siRNA sense strand
gaucacccuuguagaguuaaa

SEQ ID NO: 33678 - RNA, 21 nt, Artificial Sequence
  Marburg virus siRNA sense strand
aucacccuuguagaguuaaaa

SEQ ID NO: 33679 - RNA, 21 nt, Artificial Sequence
  Marburg virus siRNA sense strand
ucacccuuguagaguuaaaaa

SEQ ID NO: 33680 - RNA, 21 nt, Artificial Sequence
  Marburg virus siRNA sense strand
cacccuuguagaguuaaaaac

SEQ ID NO: 33681 - RNA, 21 nt, Artificial Sequence
  Marburg virus siRNA sense strand
acccuuguagaguuaaaaacu

SEQ ID NO: 33682 - RNA, 21 nt, Artificial Sequence
  Marburg virus siRNA sense strand
cccuuguagaguuaaaaacua

SEQ ID NO: 33683 - RNA, 21 nt, Artificial Sequence
  Marburg virus siRNA sense strand
ccuuguagaguuaaaaacuaa

SEQ ID NO: 33684 - RNA, 21 nt, Artificial Sequence
  Marburg virus siRNA sense strand
cuuguagaguuaaaaacuaaa

SEQ ID NO: 33685 - RNA, 21 nt, Artificial Sequence
  Marburg virus siRNA sense strand
uuguagaguuaaaaacuaaau

SEQ ID NO: 33686 - RNA, 21 nt, Artificial Sequence
  Marburg virus siRNA sense strand
uguagaguuaaaaacuaaauu

SEQ ID NO: 33687 - RNA, 21 nt, Artificial Sequence
  Marburg virus siRNA sense strand
guagaguuaaaaacuaaauua

SEQ ID NO: 33688 - RNA, 21 nt, Artificial Sequence
  Marburg virus siRNA sense strand
uagaguuaaaaacuaaauuaa

SEQ ID NO: 33689 - RNA, 21 nt, Artificial Sequence
  Marburg virus siRNA sense strand
agaguuaaaaacuaaauuaaa

SEQ ID NO: 33690 - RNA, 21 nt, Artificial Sequence
  Marburg virus siRNA sense strand
gaguuaaaaacuaaauuaaaa

SEQ ID NO: 33691 - RNA, 21 nt, Artificial Sequence
  Marburg virus siRNA sense strand
aguuaaaaacuaaauuaaaau

SEQ ID NO: 33692 - RNA, 21 nt, Artificial Sequence
  Marburg virus siRNA sense strand
guuaaaaacuaaauuaaaauu

SEQ ID NO: 33693 - RNA, 21 nt, Artificial Sequence
  Marburg virus siRNA sense strand
uuaaaaacuaaauuaaaauua

SEQ ID NO: 33694 - RNA, 21 nt, Artificial Sequence
  Marburg virus siRNA sense strand
uaaaaacuaaauuaaaauuaa

SEQ ID NO: 33695 - RNA, 21 nt, Artificial Sequence
  Marburg virus siRNA sense strand
aaaaacuaaauuaaaauuaaa

SEQ ID NO: 33696 - RNA, 21 nt, Artificial Sequence
  Marburg virus siRNA sense strand
aaaacuaaauuaaaauuaaaa

SEQ ID NO: 33697 - RNA, 21 nt, Artificial Sequence
  Marburg virus siRNA sense strand
aaacuaaauuaaaauuaaaau

SEQ ID NO: 33698 - RNA, 21 nt, Artificial Sequence
  Marburg virus siRNA sense strand
aacuaaauuaaaauuaaaauc

SEQ ID NO: 33699 - RNA, 21 nt, Artificial Sequence
  Marburg virus siRNA sense strand
acuaaauuaaaauuaaaaucc

SEQ ID NO: 33700 - RNA, 21 nt, Artificial Sequence
  Marburg virus siRNA sense strand
cuaaauuaaaauuaaaaucca

SEQ ID NO: 33701 - RNA, 21 nt, Artificial Sequence
  Marburg virus siRNA sense strand
uaaauuaaaauuaaaauccag

SEQ ID NO: 33702 - RNA, 21 nt, Artificial Sequence
  Marburg virus siRNA sense strand
aaauuaaaauuaaaauccagu

SEQ ID NO: 33703 - RNA, 21 nt, Artificial Sequence
  Marburg virus siRNA sense strand
aauuaaaauuaaaauccagug

SEQ ID NO: 33704 - RNA, 21 nt, Artificial Sequence
  Marburg virus siRNA sense strand
auuaaaauuaaaauccagugu

SEQ ID NO: 33705 - RNA, 21 nt, Artificial Sequence
  Marburg virus siRNA sense strand
uuaaaauuaaaauccaguguu

SEQ ID NO: 33706 - RNA, 21 nt, Artificial Sequence
  Marburg virus siRNA sense strand
uaaaauuaaaauccaguguua

SEQ ID NO: 33707 - RNA, 21 nt, Artificial Sequence
  Marburg virus siRNA sense strand
aaaauuaaaauccaguguuau

SEQ ID NO: 33708 - RNA, 21 nt, Artificial Sequence
  Marburg virus siRNA sense strand
aaauuaaaauccaguguuaug

SEQ ID NO: 33709 - RNA, 21 nt, Artificial Sequence
  Marburg virus siRNA sense strand
aauuaaaauccaguguuaugg

SEQ ID NO: 33710 - RNA, 21 nt, Artificial Sequence
  Marburg virus siRNA sense strand
auuaaaauccaguguuauggg

SEQ ID NO: 33711 - RNA, 21 nt, Artificial Sequence
  Marburg virus siRNA sense strand
uuaaaauccaguguuaugggu

SEQ ID NO: 33712 - RNA, 21 nt, Artificial Sequence
  Marburg virus siRNA sense strand
uaaaauccaguguuaugggug

SEQ ID NO: 33713 - RNA, 21 nt, Artificial Sequence
  Marburg virus siRNA sense strand
aaaauccaguguuauggguga

SEQ ID NO: 33714 - RNA, 21 nt, Artificial Sequence
  Marburg virus siRNA sense strand
aaauccaguguuaugggugau

SEQ ID NO: 33715 - RNA, 21 nt, Artificial Sequence
  Marburg virus siRNA sense strand
aauccaguguuaugggugaua

SEQ ID NO: 33716 - RNA, 21 nt, Artificial Sequence
  Marburg virus siRNA sense strand
auccaguguuaugggugauaa

SEQ ID NO: 33717 - RNA, 21 nt, Artificial Sequence
  Marburg virus siRNA sense strand
uccaguguuaugggugauaau

SEQ ID NO: 33718 - RNA, 21 nt, Artificial Sequence
  Marburg virus siRNA sense strand
ccaguguuaugggugauaauc

SEQ ID NO: 33719 - RNA, 21 nt, Artificial Sequence
  Marburg virus siRNA sense strand
caguguuaugggugauaauca

SEQ ID NO: 33720 - RNA, 21 nt, Artificial Sequence
  Marburg virus siRNA sense strand
aguguuaugggugauaaucaa

SEQ ID NO: 33721 - RNA, 21 nt, Artificial Sequence
  Marburg virus siRNA sense strand
guguuaugggugauaaucaau

SEQ ID NO: 33722 - RNA, 21 nt, Artificial Sequence
  Marburg virus siRNA sense strand
uguuaugggugauaaucaaug

SEQ ID NO: 33723 - RNA, 21 nt, Artificial Sequence
  Marburg virus siRNA sense strand
guuaugggugauaaucaaugu

SEQ ID NO: 33724 - RNA, 21 nt, Artificial Sequence
  Marburg virus siRNA sense strand
uuaugggugauaaucaaugua

SEQ ID NO: 33725 - RNA, 21 nt, Artificial Sequence
  Marburg virus siRNA sense strand
uaugggugauaaucaauguau

SEQ ID NO: 33726 - RNA, 21 nt, Artificial Sequence
  Marburg virus siRNA sense strand
augggugauaaucaauguaua

SEQ ID NO: 33727 - RNA, 21 nt, Artificial Sequence
  Marburg virus siRNA sense strand
ugggugauaaucaauguauaa

SEQ ID NO: 33728 - RNA, 21 nt, Artificial Sequence
  Marburg virus siRNA sense strand
gggugauaaucaauguauaac

SEQ ID NO: 33729 - RNA, 21 nt, Artificial Sequence
  Marburg virus siRNA sense strand
ggugauaaucaauguauaaca

SEQ ID NO: 33730 - RNA, 21 nt, Artificial Sequence
  Marburg virus siRNA sense strand
gugauaaucaauguauaacaa

SEQ ID NO: 33731 - RNA, 21 nt, Artificial Sequence
  Marburg virus siRNA sense strand
ugauaaucaauguauaacaac

SEQ ID NO: 33732 - RNA, 21 nt, Artificial Sequence
  Marburg virus siRNA sense strand
gauaaucaauguauaacaacu

SEQ ID NO: 33733 - RNA, 21 nt, Artificial Sequence
  Marburg virus siRNA sense strand
auaaucaauguauaacaacuc

SEQ ID NO: 33734 - RNA, 21 nt, Artificial Sequence
  Marburg virus siRNA sense strand
uaaucaauguauaacaacucu

SEQ ID NO: 33735 - RNA, 21 nt, Artificial Sequence
  Marburg virus siRNA sense strand
aaucaauguauaacaacucua

SEQ ID NO: 33736 - RNA, 21 nt, Artificial Sequence
  Marburg virus siRNA sense strand
aucaauguauaacaacucuaa

SEQ ID NO: 33737 - RNA, 21 nt, Artificial Sequence
  Marburg virus siRNA sense strand
ucaauguauaacaacucuaag

SEQ ID NO: 33738 - RNA, 21 nt, Artificial Sequence
  Marburg virus siRNA sense strand
caauguauaacaacucuaagu

SEQ ID NO: 33739 - RNA, 21 nt, Artificial Sequence
  Marburg virus siRNA sense strand
aauguauaacaacucuaaguc

SEQ ID NO: 33740 - RNA, 21 nt, Artificial Sequence
  Marburg virus siRNA sense strand
auguauaacaacucuaagucu

SEQ ID NO: 33741 - RNA, 21 nt, Artificial Sequence
  Marburg virus siRNA sense strand
uguauaacaacucuaagucuu

SEQ ID NO: 33742 - RNA, 21 nt, Artificial Sequence
  Marburg virus siRNA sense strand
guauaacaacucuaagucuuu

SEQ ID NO: 33743 - RNA, 21 nt, Artificial Sequence
  Marburg virus siRNA sense strand
uauaacaacucuaagucuuuu

SEQ ID NO: 33744 - RNA, 21 nt, Artificial Sequence
  Marburg virus siRNA sense strand
auaacaacucuaagucuuuuu

SEQ ID NO: 33745 - RNA, 21 nt, Artificial Sequence
  Marburg virus siRNA sense strand
uaacaacucuaagucuuuuuc

SEQ ID NO: 33746 - RNA, 21 nt, Artificial Sequence
  Marburg virus siRNA sense strand
aacaacucuaagucuuuuucc

SEQ ID NO: 33747 - RNA, 21 nt, Artificial Sequence
  Marburg virus siRNA sense strand
acaacucuaagucuuuuucca

SEQ ID NO: 33748 - RNA, 21 nt, Artificial Sequence
  Marburg virus siRNA sense strand
caacucuaagucuuuuuccaa

SEQ ID NO: 33749 - RNA, 21 nt, Artificial Sequence
  Marburg virus siRNA sense strand
aacucuaagucuuuuuccaau

SEQ ID NO: 33750 - RNA, 21 nt, Artificial Sequence
  Marburg virus siRNA sense strand
acucuaagucuuuuuccaauu

SEQ ID NO: 33751 - RNA, 21 nt, Artificial Sequence
  Marburg virus siRNA sense strand
cucuaagucuuuuuccaauug

SEQ ID NO: 33752 - RNA, 21 nt, Artificial Sequence
  Marburg virus siRNA sense strand
ucuaagucuuuuuccaauuga

SEQ ID NO: 33753 - RNA, 21 nt, Artificial Sequence
  Marburg virus siRNA sense strand
cuaagucuuuuuccaauugau

SEQ ID NO: 33754 - RNA, 21 nt, Artificial Sequence
  Marburg virus siRNA sense strand
uaagucuuuuuccaauugaug

SEQ ID NO: 33755 - RNA, 21 nt, Artificial Sequence
  Marburg virus siRNA sense strand
aagucuuuuuccaauugaugc

SEQ ID NO: 33756 - RNA, 21 nt, Artificial Sequence
  Marburg virus siRNA sense strand
agucuuuuuccaauugaugcu

SEQ ID NO: 33757 - RNA, 21 nt, Artificial Sequence
  Marburg virus siRNA sense strand
gucuuuuuccaauugaugcuc

SEQ ID NO: 33758 - RNA, 21 nt, Artificial Sequence
  Marburg virus siRNA sense strand
ucuuuuuccaauugaugcucc

SEQ ID NO: 33759 - RNA, 21 nt, Artificial Sequence
  Marburg virus siRNA sense strand
cuuuuuccaauugaugcuccc

SEQ ID NO: 33760 - RNA, 21 nt, Artificial Sequence
  Marburg virus siRNA sense strand
uuuuuccaauugaugcucccg

SEQ ID NO: 33761 - RNA, 21 nt, Artificial Sequence
  Marburg virus siRNA sense strand
uuuuccaauugaugcucccga

SEQ ID NO: 33762 - RNA, 21 nt, Artificial Sequence
  Marburg virus siRNA sense strand
uuuccaauugaugcucccgac

SEQ ID NO: 33763 - RNA, 21 nt, Artificial Sequence
  Marburg virus siRNA sense strand
uuccaauugaugcucccgacg

SEQ ID NO: 33764 - RNA, 21 nt, Artificial Sequence
  Marburg virus siRNA sense strand
uccaauugaugcucccgacga

SEQ ID NO: 33765 - RNA, 21 nt, Artificial Sequence
  Marburg virus siRNA sense strand
ccaauugaugcucccgacgau

SEQ ID NO: 33766 - RNA, 21 nt, Artificial Sequence
  Marburg virus siRNA sense strand
caauugaugcucccgacgauu

SEQ ID NO: 33767 - RNA, 21 nt, Artificial Sequence
  Marburg virus siRNA sense strand
aauugaugcucccgacgauua

SEQ ID NO: 33768 - RNA, 21 nt, Artificial Sequence
  Marburg virus siRNA sense strand
auugaugcucccgacgauuau

SEQ ID NO: 33769 - RNA, 21 nt, Artificial Sequence
  Marburg virus siRNA sense strand
uugaugcucccgacgauuauc

SEQ ID NO: 33770 - RNA, 21 nt, Artificial Sequence
  Marburg virus siRNA sense strand
ugaugcucccgacgauuauca

SEQ ID NO: 33771 - RNA, 21 nt, Artificial Sequence
  Marburg virus siRNA sense strand
gaugcucccgacgauuaucaa

SEQ ID NO: 33772 - RNA, 21 nt, Artificial Sequence
  Marburg virus siRNA sense strand
augcucccgacgauuaucaag

SEQ ID NO: 33773 - RNA, 21 nt, Artificial Sequence
  Marburg virus siRNA sense strand
ugcucccgacgauuaucaaga

SEQ ID NO: 33774 - RNA, 21 nt, Artificial Sequence
  Marburg virus siRNA sense strand
gcucccgacgauuaucaagag

SEQ ID NO: 33775 - RNA, 21 nt, Artificial Sequence
  Marburg virus siRNA sense strand
cucccgacgauuaucaagaga

SEQ ID NO: 33776 - RNA, 21 nt, Artificial Sequence
  Marburg virus siRNA sense strand
ucccgacgauuaucaagagaa

SEQ ID NO: 33777 - RNA, 21 nt, Artificial Sequence
  Marburg virus siRNA sense strand
cccgacgauuaucaagagaac

SEQ ID NO: 33778 - RNA, 21 nt, Artificial Sequence
  Marburg virus siRNA sense strand
ccgacgauuaucaagagaacg

SEQ ID NO: 33779 - RNA, 21 nt, Artificial Sequence
  Marburg virus siRNA sense strand
cgacgauuaucaagagaacga

SEQ ID NO: 33780 - RNA, 21 nt, Artificial Sequence
  Marburg virus siRNA sense strand
gacgauuaucaagagaacgaa

SEQ ID NO: 33781 - RNA, 21 nt, Artificial Sequence
  Marburg virus siRNA sense strand
acgauuaucaagagaacgaag

SEQ ID NO: 33782 - RNA, 21 nt, Artificial Sequence
  Marburg virus siRNA sense strand
cgauuaucaagagaacgaagc

SEQ ID NO: 33783 - RNA, 21 nt, Artificial Sequence
  Marburg virus siRNA sense strand
gauuaucaagagaacgaagcu

SEQ ID NO: 33784 - RNA, 21 nt, Artificial Sequence
  Marburg virus siRNA sense strand
auuaucaagagaacgaagcug

SEQ ID NO: 33785 - RNA, 21 nt, Artificial Sequence
  Marburg virus siRNA sense strand
uuaucaagagaacgaagcuga

SEQ ID NO: 33786 - RNA, 21 nt, Artificial Sequence
  Marburg virus siRNA sense strand
uaucaagagaacgaagcugaa

SEQ ID NO: 33787 - RNA, 21 nt, Artificial Sequence
  Marburg virus siRNA sense strand
aucaagagaacgaagcugaau

SEQ ID NO: 33788 - RNA, 21 nt, Artificial Sequence
  Marburg virus siRNA sense strand
ucaagagaacgaagcugaauu

SEQ ID NO: 33789 - RNA, 21 nt, Artificial Sequence
  Marburg virus siRNA sense strand
caagagaacgaagcugaauua

SEQ ID NO: 33790 - RNA, 21 nt, Artificial Sequence
  Marburg virus siRNA sense strand
aagagaacgaagcugaauuaa

SEQ ID NO: 33791 - RNA, 21 nt, Artificial Sequence
  Marburg virus siRNA sense strand
agagaacgaagcugaauuaaa

SEQ ID NO: 33792 - RNA, 21 nt, Artificial Sequence
  Marburg virus siRNA sense strand
gagaacgaagcugaauuaaau

SEQ ID NO: 33793 - RNA, 21 nt, Artificial Sequence
  Marburg virus siRNA sense strand
agaacgaagcugaauuaaaug

SEQ ID NO: 33794 - RNA, 21 nt, Artificial Sequence
  Marburg virus siRNA sense strand
gaacgaagcugaauuaaaugc

SEQ ID NO: 33795 - RNA, 21 nt, Artificial Sequence
  Marburg virus siRNA sense strand
aacgaagcugaauuaaaugcg

SEQ ID NO: 33796 - RNA, 21 nt, Artificial Sequence
  Marburg virus siRNA sense strand
acgaagcugaauuaaaugcgg

SEQ ID NO: 33797 - RNA, 21 nt, Artificial Sequence
  Marburg virus siRNA sense strand
cgaagcugaauuaaaugcggc

SEQ ID NO: 33798 - RNA, 21 nt, Artificial Sequence
  Marburg virus siRNA sense strand
gaagcugaauuaaaugcggca

SEQ ID NO: 33799 - RNA, 21 nt, Artificial Sequence
  Marburg virus siRNA sense strand
aagcugaauuaaaugcggcac

SEQ ID NO: 33800 - RNA, 21 nt, Artificial Sequence
  Marburg virus siRNA sense strand
agcugaauuaaaugcggcacg

SEQ ID NO: 33801 - RNA, 21 nt, Artificial Sequence
  Marburg virus siRNA sense strand
gcugaauuaaaugcggcacga

SEQ ID NO: 33802 - RNA, 21 nt, Artificial Sequence
  Marburg virus siRNA sense strand
cugaauuaaaugcggcacgag

SEQ ID NO: 33803 - RNA, 21 nt, Artificial Sequence
  Marburg virus siRNA sense strand
ugaauuaaaugcggcacgagu

SEQ ID NO: 33804 - RNA, 21 nt, Artificial Sequence
  Marburg virus siRNA sense strand
gaauuaaaugcggcacgaguu

SEQ ID NO: 33805 - RNA, 21 nt, Artificial Sequence
  Marburg virus siRNA sense strand
aauuaaaugcggcacgaguug

SEQ ID NO: 33806 - RNA, 21 nt, Artificial Sequence
  Marburg virus siRNA sense strand
auuaaaugcggcacgaguugc

SEQ ID NO: 33807 - RNA, 21 nt, Artificial Sequence
  Marburg virus siRNA sense strand
uuaaaugcggcacgaguugcu

SEQ ID NO: 33808 - RNA, 21 nt, Artificial Sequence
  Marburg virus siRNA sense strand
uaaaugcggcacgaguugcug

SEQ ID NO: 33809 - RNA, 21 nt, Artificial Sequence
  Marburg virus siRNA sense strand
aaaugcggcacgaguugcugu

SEQ ID NO: 33810 - RNA, 21 nt, Artificial Sequence
  Marburg virus siRNA sense strand
aaugcggcacgaguugcuguc

SEQ ID NO: 33811 - RNA, 21 nt, Artificial Sequence
  Marburg virus siRNA sense strand
augcggcacgaguugcugucg

SEQ ID NO: 33812 - RNA, 21 nt, Artificial Sequence
  Marburg virus siRNA sense strand
ugcggcacgaguugcugucga

SEQ ID NO: 33813 - RNA, 21 nt, Artificial Sequence
  Marburg virus siRNA sense strand
gcggcacgaguugcugucgaa

SEQ ID NO: 33814 - RNA, 21 nt, Artificial Sequence
  Marburg virus siRNA sense strand
cggcacgaguugcugucgaau

SEQ ID NO: 33815 - RNA, 21 nt, Artificial Sequence
  Marburg virus siRNA sense strand
ggcacgaguugcugucgaauu

SEQ ID NO: 33816 - RNA, 21 nt, Artificial Sequence
  Marburg virus siRNA sense strand
gcacgaguugcugucgaauua

SEQ ID NO: 33817 - RNA, 21 nt, Artificial Sequence
  Marburg virus siRNA sense strand
cacgaguugcugucgaauuag

SEQ ID NO: 33818 - RNA, 21 nt, Artificial Sequence
  Marburg virus siRNA sense strand
acgaguugcugucgaauuagc

SEQ ID NO: 33819 - RNA, 21 nt, Artificial Sequence
  Marburg virus siRNA sense strand
cgaguugcugucgaauuagcu

SEQ ID NO: 33820 - RNA, 21 nt, Artificial Sequence
  Marburg virus siRNA sense strand
gaguugcugucgaauuagcua

SEQ ID NO: 33821 - RNA, 21 nt, Artificial Sequence
  Marburg virus siRNA sense strand
aguugcugucgaauuagcuau

SEQ ID NO: 33822 - RNA, 21 nt, Artificial Sequence
  Marburg virus siRNA sense strand
guugcugucgaauuagcuauu

SEQ ID NO: 33823 - RNA, 21 nt, Artificial Sequence
  Marburg virus siRNA sense strand
uugcugucgaauuagcuauua

SEQ ID NO: 33824 - RNA, 21 nt, Artificial Sequence
  Marburg virus siRNA sense strand
ugcugucgaauuagcuauuac

SEQ ID NO: 33825 - RNA, 21 nt, Artificial Sequence
  Marburg virus siRNA sense strand
gcugucgaauuagcuauuacu

SEQ ID NO: 33826 - RNA, 21 nt, Artificial Sequence
  Marburg virus siRNA sense strand
cugucgaauuagcuauuacua

SEQ ID NO: 33827 - RNA, 21 nt, Artificial Sequence
  Marburg virus siRNA sense strand
ugucgaauuagcuauuacuac

SEQ ID NO: 33828 - RNA, 21 nt, Artificial Sequence
  Marburg virus siRNA sense strand
gucgaauuagcuauuacuacg

SEQ ID NO: 33829 - RNA, 21 nt, Artificial Sequence
  Marburg virus siRNA sense strand
ucgaauuagcuauuacuacgg

SEQ ID NO: 33830 - RNA, 21 nt, Artificial Sequence
  Marburg virus siRNA sense strand
cgaauuagcuauuacuacggg

SEQ ID NO: 33831 - RNA, 21 nt, Artificial Sequence
  Marburg virus siRNA sense strand
gaauuagcuauuacuacgggu

SEQ ID NO: 33832 - RNA, 21 nt, Artificial Sequence
  Marburg virus siRNA sense strand
aauuagcuauuacuacggguu

SEQ ID NO: 33833 - RNA, 21 nt, Artificial Sequence
  Marburg virus siRNA sense strand
auuagcuauuacuacggguua

SEQ ID NO: 33834 - RNA, 21 nt, Artificial Sequence
  Marburg virus siRNA sense strand
uuagcuauuacuacggguuau

SEQ ID NO: 33835 - RNA, 21 nt, Artificial Sequence
  Marburg virus siRNA sense strand
uagcuauuacuacggguuaug

SEQ ID NO: 33836 - RNA, 21 nt, Artificial Sequence
  Marburg virus siRNA sense strand
agcuauuacuacggguuauga

SEQ ID NO: 33837 - RNA, 21 nt, Artificial Sequence
  Marburg virus siRNA sense strand
gcuauuacuacggguuaugau

SEQ ID NO: 33838 - RNA, 21 nt, Artificial Sequence
  Marburg virus siRNA sense strand
cuauuacuacggguuaugaug

SEQ ID NO: 33839 - RNA, 21 nt, Artificial Sequence
  Marburg virus siRNA sense strand
uauuacuacggguuaugaugg

SEQ ID NO: 33840 - RNA, 21 nt, Artificial Sequence
  Marburg virus siRNA sense strand
auuacuacggguuaugauggu

SEQ ID NO: 33841 - RNA, 21 nt, Artificial Sequence
  Marburg virus siRNA sense strand
uuacuacggguuaugauggua

SEQ ID NO: 33842 - RNA, 21 nt, Artificial Sequence
  Marburg virus siRNA sense strand
uacuacggguuaugaugguau

SEQ ID NO: 33843 - RNA, 21 nt, Artificial Sequence
  Marburg virus siRNA sense strand
acuacggguuaugaugguaua

SEQ ID NO: 33844 - RNA, 21 nt, Artificial Sequence
  Marburg virus siRNA sense strand
cuacggguuaugaugguauau

SEQ ID NO: 33845 - RNA, 21 nt, Artificial Sequence
  Marburg virus siRNA sense strand
uacggguuaugaugguauauu

SEQ ID NO: 33846 - RNA, 21 nt, Artificial Sequence
  Marburg virus siRNA sense strand
acggguuaugaugguauauuu

SEQ ID NO: 33847 - RNA, 21 nt, Artificial Sequence
  Marburg virus siRNA sense strand
cggguuaugaugguauauuuu

SEQ ID NO: 33848 - RNA, 21 nt, Artificial Sequence
  Marburg virus siRNA sense strand
ggguuaugaugguauauuuuu

SEQ ID NO: 33849 - RNA, 21 nt, Artificial Sequence
  Marburg virus siRNA sense strand
gguuaugaugguauauuuuug

SEQ ID NO: 33850 - RNA, 21 nt, Artificial Sequence
  Marburg virus siRNA sense strand
guuaugaugguauauuuuuga

SEQ ID NO: 33851 - RNA, 21 nt, Artificial Sequence
  Marburg virus siRNA sense strand
uuaugaugguauauuuuugaa

SEQ ID NO: 33852 - RNA, 21 nt, Artificial Sequence
  Marburg virus siRNA sense strand
uaugaugguauauuuuugaag

SEQ ID NO: 33853 - RNA, 21 nt, Artificial Sequence
  Marburg virus siRNA sense strand
augaugguauauuuuugaagc

SEQ ID NO: 33854 - RNA, 21 nt, Artificial Sequence
  Marburg virus siRNA sense strand
ugaugguauauuuuugaagcc

SEQ ID NO: 33855 - RNA, 21 nt, Artificial Sequence
  Marburg virus siRNA sense strand
gaugguauauuuuugaagccu

SEQ ID NO: 33856 - RNA, 21 nt, Artificial Sequence
  Marburg virus siRNA sense strand
augguauauuuuugaagccug

SEQ ID NO: 33857 - RNA, 21 nt, Artificial Sequence
  Marburg virus siRNA sense strand
ugguauauuuuugaagccuga

SEQ ID NO: 33858 - RNA, 21 nt, Artificial Sequence
  Marburg virus siRNA sense strand
gguauauuuuugaagccugaa

SEQ ID NO: 33859 - RNA, 21 nt, Artificial Sequence
  Marburg virus siRNA sense strand
guauauuuuugaagccugaag

SEQ ID NO: 33860 - RNA, 21 nt, Artificial Sequence
  Marburg virus siRNA sense strand
uauauuuuugaagccugaaga

SEQ ID NO: 33861 - RNA, 21 nt, Artificial Sequence
  Marburg virus siRNA sense strand
auauuuuugaagccugaagaa

SEQ ID NO: 33862 - RNA, 21 nt, Artificial Sequence
  Marburg virus siRNA sense strand
uauuuuugaagccugaagaaa

SEQ ID NO: 33863 - RNA, 21 nt, Artificial Sequence
  Marburg virus siRNA sense strand
auuuuugaagccugaagaaac

SEQ ID NO: 33864 - RNA, 21 nt, Artificial Sequence
  Marburg virus siRNA sense strand
uuuuugaagccugaagaaaca

SEQ ID NO: 33865 - RNA, 21 nt, Artificial Sequence
  Marburg virus siRNA sense strand
uuuugaagccugaagaaacau

SEQ ID NO: 33866 - RNA, 21 nt, Artificial Sequence
  Marburg virus siRNA sense strand
uuugaagccugaagaaacauu

SEQ ID NO: 33867 - RNA, 21 nt, Artificial Sequence
  Marburg virus siRNA sense strand
uugaagccugaagaaacauuu

SEQ ID NO: 33868 - RNA, 21 nt, Artificial Sequence
  Marburg virus siRNA sense strand
ugaagccugaagaaacauuug

SEQ ID NO: 33869 - RNA, 21 nt, Artificial Sequence
  Marburg virus siRNA sense strand
gaagccugaagaaacauuugu

SEQ ID NO: 33870 - RNA, 21 nt, Artificial Sequence
  Marburg virus siRNA sense strand
aagccugaagaaacauuuguc

SEQ ID NO: 33871 - RNA, 21 nt, Artificial Sequence
  Marburg virus siRNA sense strand
agccugaagaaacauuugucc

SEQ ID NO: 33872 - RNA, 21 nt, Artificial Sequence
  Marburg virus siRNA sense strand
gccugaagaaacauuugucca

SEQ ID NO: 33873 - RNA, 21 nt, Artificial Sequence
  Marburg virus siRNA sense strand
ccugaagaaacauuuguccau

SEQ ID NO: 33874 - RNA, 21 nt, Artificial Sequence
  Marburg virus siRNA sense strand
cugaagaaacauuuguccauu

SEQ ID NO: 33875 - RNA, 21 nt, Artificial Sequence
  Marburg virus siRNA sense strand
ugaagaaacauuuguccauuc

SEQ ID NO: 33876 - RNA, 21 nt, Artificial Sequence
  Marburg virus siRNA sense strand
gaagaaacauuuguccauuca

SEQ ID NO: 33877 - RNA, 21 nt, Artificial Sequence
  Marburg virus siRNA sense strand
aagaaacauuuguccauucag

SEQ ID NO: 33878 - RNA, 21 nt, Artificial Sequence
  Marburg virus siRNA sense strand
agaaacauuuguccauucagg

SEQ ID NO: 33879 - RNA, 21 nt, Artificial Sequence
  Marburg virus siRNA sense strand
gaaacauuuguccauucaggg

SEQ ID NO: 33880 - RNA, 21 nt, Artificial Sequence
  Marburg virus siRNA sense strand
aaacauuuguccauucagggu

SEQ ID NO: 33881 - RNA, 21 nt, Artificial Sequence
  Marburg virus siRNA sense strand
aacauuuguccauucaggguu

SEQ ID NO: 33882 - RNA, 21 nt, Artificial Sequence
  Marburg virus siRNA sense strand
acauuuguccauucaggguuc

SEQ ID NO: 33883 - RNA, 21 nt, Artificial Sequence
  Marburg virus siRNA sense strand
cauuuguccauucaggguuca

SEQ ID NO: 33884 - RNA, 21 nt, Artificial Sequence
  Marburg virus siRNA sense strand
auuuguccauucaggguucau

SEQ ID NO: 33885 - RNA, 21 nt, Artificial Sequence
  Marburg virus siRNA sense strand
uuuguccauucaggguucauu

SEQ ID NO: 33886 - RNA, 21 nt, Artificial Sequence
  Marburg virus siRNA sense strand
uuguccauucaggguucauuu

SEQ ID NO: 33887 - RNA, 21 nt, Artificial Sequence
  Marburg virus siRNA sense strand
uguccauucaggguucauuua

SEQ ID NO: 33888 - RNA, 21 nt, Artificial Sequence
  Marburg virus siRNA sense strand
guccauucaggguucauuuau

SEQ ID NO: 33889 - RNA, 21 nt, Artificial Sequence
  Marburg virus siRNA sense strand
uccauucaggguucauuuauu

SEQ ID NO: 33890 - RNA, 21 nt, Artificial Sequence
  Marburg virus siRNA sense strand
ccauucaggguucauuuauuu

SEQ ID NO: 33891 - RNA, 21 nt, Artificial Sequence
  Marburg virus siRNA sense strand
cauucaggguucauuuauuuu

SEQ ID NO: 33892 - RNA, 21 nt, Artificial Sequence
  Marburg virus siRNA sense strand
auucaggguucauuuauuuug

SEQ ID NO: 33893 - RNA, 21 nt, Artificial Sequence
  Marburg virus siRNA sense strand
uucaggguucauuuauuuugg

SEQ ID NO: 33894 - RNA, 21 nt, Artificial Sequence
  Marburg virus siRNA sense strand
ucaggguucauuuauuuuggu

SEQ ID NO: 33895 - RNA, 21 nt, Artificial Sequence
  Marburg virus siRNA sense strand
caggguucauuuauuuuggua

SEQ ID NO: 33896 - RNA, 21 nt, Artificial Sequence
  Marburg virus siRNA sense strand
aggguucauuuauuuugguaa

SEQ ID NO: 33897 - RNA, 21 nt, Artificial Sequence
  Marburg virus siRNA sense strand
ggguucauuuauuuugguaaa

SEQ ID NO: 33898 - RNA, 21 nt, Artificial Sequence
  Marburg virus siRNA sense strand
gguucauuuauuuugguaaaa

SEQ ID NO: 33899 - RNA, 21 nt, Artificial Sequence
  Marburg virus siRNA sense strand
guucauuuauuuugguaaaaa

SEQ ID NO: 33900 - RNA, 21 nt, Artificial Sequence
  Marburg virus siRNA sense strand
uucauuuauuuugguaaaaag

SEQ ID NO: 33901 - RNA, 21 nt, Artificial Sequence
  Marburg virus siRNA sense strand
ucauuuauuuugguaaaaagc

SEQ ID NO: 33902 - RNA, 21 nt, Artificial Sequence
  Marburg virus siRNA sense strand
cauuuauuuugguaaaaagca

SEQ ID NO: 33903 - RNA, 21 nt, Artificial Sequence
  Marburg virus siRNA sense strand
auuuauuuugguaaaaagcaa

SEQ ID NO: 33904 - RNA, 21 nt, Artificial Sequence
  Marburg virus siRNA sense strand
uuuauuuugguaaaaagcaau

SEQ ID NO: 33905 - RNA, 21 nt, Artificial Sequence
  Marburg virus siRNA sense strand
uuauuuugguaaaaagcaaua

SEQ ID NO: 33906 - RNA, 21 nt, Artificial Sequence
  Marburg virus siRNA sense strand
uauuuugguaaaaagcaauac

SEQ ID NO: 33907 - RNA, 21 nt, Artificial Sequence
  Marburg virus siRNA sense strand
auuuugguaaaaagcaauacc

SEQ ID NO: 33908 - RNA, 21 nt, Artificial Sequence
  Marburg virus siRNA sense strand
uuuugguaaaaagcaauaccu

SEQ ID NO: 33909 - RNA, 21 nt, Artificial Sequence
  Marburg virus siRNA sense strand
uuugguaaaaagcaauaccuc

SEQ ID NO: 33910 - RNA, 21 nt, Artificial Sequence
  Marburg virus siRNA sense strand
uugguaaaaagcaauaccuca

SEQ ID NO: 33911 - RNA, 21 nt, Artificial Sequence
  Marburg virus siRNA sense strand
ugguaaaaagcaauaccucaa

SEQ ID NO: 33912 - RNA, 21 nt, Artificial Sequence
  Marburg virus siRNA sense strand
gguaaaaagcaauaccucaac

SEQ ID NO: 33913 - RNA, 21 nt, Artificial Sequence
  Marburg virus siRNA sense strand
guaaaaagcaauaccucaacg

SEQ ID NO: 33914 - RNA, 21 nt, Artificial Sequence
  Marburg virus siRNA sense strand
uaaaaagcaauaccucaacgg

SEQ ID NO: 33915 - RNA, 21 nt, Artificial Sequence
  Marburg virus siRNA sense strand
aaaaagcaauaccucaacggu

SEQ ID NO: 33916 - RNA, 21 nt, Artificial Sequence
  Marburg virus siRNA sense strand
aaaagcaauaccucaacggug

SEQ ID NO: 33917 - RNA, 21 nt, Artificial Sequence
  Marburg virus siRNA sense strand
aaagcaauaccucaacggugu

SEQ ID NO: 33918 - RNA, 21 nt, Artificial Sequence
  Marburg virus siRNA sense strand
aagcaauaccucaacgguguu

SEQ ID NO: 33919 - RNA, 21 nt, Artificial Sequence
  Marburg virus siRNA sense strand
agcaauaccucaacgguguuc

SEQ ID NO: 33920 - RNA, 21 nt, Artificial Sequence
  Marburg virus siRNA sense strand
gcaauaccucaacgguguuca

SEQ ID NO: 33921 - RNA, 21 nt, Artificial Sequence
  Marburg virus siRNA sense strand
caauaccucaacgguguucaa

SEQ ID NO: 33922 - RNA, 21 nt, Artificial Sequence
  Marburg virus siRNA sense strand
aauaccucaacgguguucaac

SEQ ID NO: 33923 - RNA, 21 nt, Artificial Sequence
  Marburg virus siRNA sense strand
auaccucaacgguguucaacu

SEQ ID NO: 33924 - RNA, 21 nt, Artificial Sequence
  Marburg virus siRNA sense strand
uaccucaacgguguucaacug

SEQ ID NO: 33925 - RNA, 21 nt, Artificial Sequence
  Marburg virus siRNA sense strand
accucaacgguguucaacugc

SEQ ID NO: 33926 - RNA, 21 nt, Artificial Sequence
  Marburg virus siRNA sense strand
ccucaacgguguucaacugcc

SEQ ID NO: 33927 - RNA, 21 nt, Artificial Sequence
  Marburg virus siRNA sense strand
cucaacgguguucaacugcca

SEQ ID NO: 33928 - RNA, 21 nt, Artificial Sequence
  Marburg virus siRNA sense strand
ucaacgguguucaacugccac

SEQ ID NO: 33929 - RNA, 21 nt, Artificial Sequence
  Marburg virus siRNA sense strand
caacgguguucaacugccaca

SEQ ID NO: 33930 - RNA, 21 nt, Artificial Sequence
  Marburg virus siRNA sense strand
aacgguguucaacugccacaa

SEQ ID NO: 33931 - RNA, 21 nt, Artificial Sequence
  Marburg virus siRNA sense strand
acgguguucaacugccacaau

SEQ ID NO: 33932 - RNA, 21 nt, Artificial Sequence
  Marburg virus siRNA sense strand
cgguguucaacugccacaauc

SEQ ID NO: 33933 - RNA, 21 nt, Artificial Sequence
  Marburg virus siRNA sense strand
gguguucaacugccacaauca

SEQ ID NO: 33934 - RNA, 21 nt, Artificial Sequence
  Marburg virus siRNA sense strand
guguucaacugccacaaucau

SEQ ID NO: 33935 - RNA, 21 nt, Artificial Sequence
  Marburg virus siRNA sense strand
uguucaacugccacaaucauu

SEQ ID NO: 33936 - RNA, 21 nt, Artificial Sequence
  Marburg virus siRNA sense strand
guucaacugccacaaucauug

SEQ ID NO: 33937 - RNA, 21 nt, Artificial Sequence
  Marburg virus siRNA sense strand
uucaacugccacaaucauuga

SEQ ID NO: 33938 - RNA, 21 nt, Artificial Sequence
  Marburg virus siRNA sense strand
ucaacugccacaaucauugaa

SEQ ID NO: 33939 - RNA, 21 nt, Artificial Sequence
  Marburg virus siRNA sense strand
caacugccacaaucauugaaa

SEQ ID NO: 33940 - RNA, 21 nt, Artificial Sequence
  Marburg virus siRNA sense strand
aacugccacaaucauugaaaa

SEQ ID NO: 33941 - RNA, 21 nt, Artificial Sequence
  Marburg virus siRNA sense strand
acugccacaaucauugaaaac

SEQ ID NO: 33942 - RNA, 21 nt, Artificial Sequence
  Marburg virus siRNA sense strand
cugccacaaucauugaaaaca

SEQ ID NO: 33943 - RNA, 21 nt, Artificial Sequence
  Marburg virus siRNA sense strand
ugccacaaucauugaaaacaa

SEQ ID NO: 33944 - RNA, 21 nt, Artificial Sequence
  Marburg virus siRNA sense strand
gccacaaucauugaaaacaau

SEQ ID NO: 33945 - RNA, 21 nt, Artificial Sequence
  Marburg virus siRNA sense strand
ccacaaucauugaaaacaaug

SEQ ID NO: 33946 - RNA, 21 nt, Artificial Sequence
  Marburg virus siRNA sense strand
cacaaucauugaaaacaaugg

SEQ ID NO: 33947 - RNA, 21 nt, Artificial Sequence
  Marburg virus siRNA sense strand
acaaucauugaaaacaauggc

SEQ ID NO: 33948 - RNA, 21 nt, Artificial Sequence
  Marburg virus siRNA sense strand
caaucauugaaaacaauggca

SEQ ID NO: 33949 - RNA, 21 nt, Artificial Sequence
  Marburg virus siRNA sense strand
aaucauugaaaacaauggcaa

SEQ ID NO: 33950 - RNA, 21 nt, Artificial Sequence
  Marburg virus siRNA sense strand
aucauugaaaacaauggcaag

SEQ ID NO: 33951 - RNA, 21 nt, Artificial Sequence
  Marburg virus siRNA sense strand
ucauugaaaacaauggcaaga

SEQ ID NO: 33952 - RNA, 21 nt, Artificial Sequence
  Marburg virus siRNA sense strand
cauugaaaacaauggcaagau

SEQ ID NO: 33953 - RNA, 21 nt, Artificial Sequence
  Marburg virus siRNA sense strand
auugaaaacaauggcaagaug

SEQ ID NO: 33954 - RNA, 21 nt, Artificial Sequence
  Marburg virus siRNA sense strand
uugaaaacaauggcaagaugu

SEQ ID NO: 33955 - RNA, 21 nt, Artificial Sequence
  Marburg virus siRNA sense strand
ugaaaacaauggcaagaugug

SEQ ID NO: 33956 - RNA, 21 nt, Artificial Sequence
  Marburg virus siRNA sense strand
gaaaacaauggcaagaugugg

SEQ ID NO: 33957 - RNA, 21 nt, Artificial Sequence
  Marburg virus siRNA sense strand
aaaacaauggcaagaugugga

SEQ ID NO: 33958 - RNA, 21 nt, Artificial Sequence
  Marburg virus siRNA sense strand
aaacaauggcaagauguggac

SEQ ID NO: 33959 - RNA, 21 nt, Artificial Sequence
  Marburg virus siRNA sense strand
aacaauggcaagauguggacc

SEQ ID NO: 33960 - RNA, 21 nt, Artificial Sequence
  Marburg virus siRNA sense strand
acaauggcaagauguggaccc

SEQ ID NO: 33961 - RNA, 21 nt, Artificial Sequence
  Marburg virus siRNA sense strand
caauggcaagauguggacccu

SEQ ID NO: 33962 - RNA, 21 nt, Artificial Sequence
  Marburg virus siRNA sense strand
aauggcaagauguggacccuu

SEQ ID NO: 33963 - RNA, 21 nt, Artificial Sequence
  Marburg virus siRNA sense strand
auggcaagauguggacccuua

SEQ ID NO: 33964 - RNA, 21 nt, Artificial Sequence
  Marburg virus siRNA sense strand
uggcaagauguggacccuuau

SEQ ID NO: 33965 - RNA, 21 nt, Artificial Sequence
  Marburg virus siRNA sense strand
ggcaagauguggacccuuauc

SEQ ID NO: 33966 - RNA, 21 nt, Artificial Sequence
  Marburg virus siRNA sense strand
gcaagauguggacccuuaucu

SEQ ID NO: 33967 - RNA, 21 nt, Artificial Sequence
  Marburg virus siRNA sense strand
caagauguggacccuuaucug

SEQ ID NO: 33968 - RNA, 21 nt, Artificial Sequence
  Marburg virus siRNA sense strand
aagauguggacccuuaucuga

SEQ ID NO: 33969 - RNA, 21 nt, Artificial Sequence
  Marburg virus siRNA sense strand
agauguggacccuuaucugac

SEQ ID NO: 33970 - RNA, 21 nt, Artificial Sequence
  Marburg virus siRNA sense strand
gauguggacccuuaucugacu

SEQ ID NO: 33971 - RNA, 21 nt, Artificial Sequence
  Marburg virus siRNA sense strand
auguggacccuuaucugacuc

SEQ ID NO: 33972 - RNA, 21 nt, Artificial Sequence
  Marburg virus siRNA sense strand
uguggacccuuaucugacucu

SEQ ID NO: 33973 - RNA, 21 nt, Artificial Sequence
  Marburg virus siRNA sense strand
guggacccuuaucugacucua

SEQ ID NO: 33974 - RNA, 21 nt, Artificial Sequence
  Marburg virus siRNA sense strand
uggacccuuaucugacucuau

SEQ ID NO: 33975 - RNA, 21 nt, Artificial Sequence
  Marburg virus siRNA sense strand
ggacccuuaucugacucuauu

SEQ ID NO: 33976 - RNA, 21 nt, Artificial Sequence
  Marburg virus siRNA sense strand
gacccuuaucugacucuauuu

SEQ ID NO: 33977 - RNA, 21 nt, Artificial Sequence
  Marburg virus siRNA sense strand
acccuuaucugacucuauuuu

SEQ ID NO: 33978 - RNA, 21 nt, Artificial Sequence
  Marburg virus siRNA sense strand
cccuuaucugacucuauuuuu

SEQ ID NO: 33979 - RNA, 21 nt, Artificial Sequence
  Marburg virus siRNA sense strand
ccuuaucugacucuauuuuug

SEQ ID NO: 33980 - RNA, 21 nt, Artificial Sequence
  Marburg virus siRNA sense strand
cuuaucugacucuauuuuuga

SEQ ID NO: 33981 - RNA, 21 nt, Artificial Sequence
  Marburg virus siRNA sense strand
uuaucugacucuauuuuugau

SEQ ID NO: 33982 - RNA, 21 nt, Artificial Sequence
  Marburg virus siRNA sense strand
uaucugacucuauuuuugaug

SEQ ID NO: 33983 - RNA, 21 nt, Artificial Sequence
  Marburg virus siRNA sense strand
aucugacucuauuuuugauga

SEQ ID NO: 33984 - RNA, 21 nt, Artificial Sequence
  Marburg virus siRNA sense strand
ucugacucuauuuuugaugau

SEQ ID NO: 33985 - RNA, 21 nt, Artificial Sequence
  Marburg virus siRNA sense strand
cugacucuauuuuugaugauc

SEQ ID NO: 33986 - RNA, 21 nt, Artificial Sequence
  Marburg virus siRNA sense strand
ugacucuauuuuugaugaucu

SEQ ID NO: 33987 - RNA, 21 nt, Artificial Sequence
  Marburg virus siRNA sense strand
gacucuauuuuugaugaucuu

SEQ ID NO: 33988 - RNA, 21 nt, Artificial Sequence
  Marburg virus siRNA sense strand
acucuauuuuugaugaucuuc

SEQ ID NO: 33989 - RNA, 21 nt, Artificial Sequence
  Marburg virus siRNA sense strand
cucuauuuuugaugaucuuca

SEQ ID NO: 33990 - RNA, 21 nt, Artificial Sequence
  Marburg virus siRNA sense strand
ucuauuuuugaugaucuucaa

SEQ ID NO: 33991 - RNA, 21 nt, Artificial Sequence
  Marburg virus siRNA sense strand
cuauuuuugaugaucuucaag

SEQ ID NO: 33992 - RNA, 21 nt, Artificial Sequence
  Marburg virus siRNA sense strand
uauuuuugaugaucuucaagg

SEQ ID NO: 33993 - RNA, 21 nt, Artificial Sequence
  Marburg virus siRNA sense strand
auuuuugaugaucuucaaggu

SEQ ID NO: 33994 - RNA, 21 nt, Artificial Sequence
  Marburg virus siRNA sense strand
uuuuugaugaucuucaagguu

SEQ ID NO: 33995 - RNA, 21 nt, Artificial Sequence
  Marburg virus siRNA sense strand
uuuugaugaucuucaagguuc

SEQ ID NO: 33996 - RNA, 21 nt, Artificial Sequence
  Marburg virus siRNA sense strand
uuugaugaucuucaagguucc

SEQ ID NO: 33997 - RNA, 21 nt, Artificial Sequence
  Marburg virus siRNA sense strand
uugaugaucuucaagguuccc

SEQ ID NO: 33998 - RNA, 21 nt, Artificial Sequence
  Marburg virus siRNA sense strand
ugaugaucuucaagguucccu

SEQ ID NO: 33999 - RNA, 21 nt, Artificial Sequence
  Marburg virus siRNA sense strand
gaugaucuucaagguucccug

SEQ ID NO: 34000 - RNA, 21 nt, Artificial Sequence
  Marburg virus siRNA sense strand
augaucuucaagguucccugg

SEQ ID NO: 34001 - RNA, 21 nt, Artificial Sequence
  Marburg virus siRNA sense strand
ugaucuucaagguucccuggc

SEQ ID NO: 34002 - RNA, 21 nt, Artificial Sequence
  Marburg virus siRNA sense strand
gaucuucaagguucccuggcc

SEQ ID NO: 34003 - RNA, 21 nt, Artificial Sequence
  Marburg virus siRNA sense strand
aucuucaagguucccuggcca

SEQ ID NO: 34004 - RNA, 21 nt, Artificial Sequence
  Marburg virus siRNA sense strand
ucuucaagguucccuggccag

SEQ ID NO: 34005 - RNA, 21 nt, Artificial Sequence
  Marburg virus siRNA sense strand
cuucaagguucccuggccagu

SEQ ID NO: 34006 - RNA, 21 nt, Artificial Sequence
  Marburg virus siRNA sense strand
uucaagguucccuggccagua

SEQ ID NO: 34007 - RNA, 21 nt, Artificial Sequence
  Marburg virus siRNA sense strand
ucaagguucccuggccaguau

SEQ ID NO: 34008 - RNA, 21 nt, Artificial Sequence
  Marburg virus siRNA sense strand
caagguucccuggccaguauu

SEQ ID NO: 34009 - RNA, 21 nt, Artificial Sequence
  Marburg virus siRNA sense strand
aagguucccuggccaguauug

SEQ ID NO: 34010 - RNA, 21 nt, Artificial Sequence
  Marburg virus siRNA sense strand
agguucccuggccaguauugg

SEQ ID NO: 34011 - RNA, 21 nt, Artificial Sequence
  Marburg virus siRNA sense strand
gguucccuggccaguauuggu

SEQ ID NO: 34012 - RNA, 21 nt, Artificial Sequence
  Marburg virus siRNA sense strand
guucccuggccaguauuggua

SEQ ID NO: 34013 - RNA, 21 nt, Artificial Sequence
  Marburg virus siRNA sense strand
uucccuggccaguauugguac

SEQ ID NO: 34014 - RNA, 21 nt, Artificial Sequence
  Marburg virus siRNA sense strand
ucccuggccaguauugguaca

SEQ ID NO: 34015 - RNA, 21 nt, Artificial Sequence
  Marburg virus siRNA sense strand
cccuggccaguauugguacau

SEQ ID NO: 34016 - RNA, 21 nt, Artificial Sequence
  Marburg virus siRNA sense strand
ccuggccaguauugguacauc

SEQ ID NO: 34017 - RNA, 21 nt, Artificial Sequence
  Marburg virus siRNA sense strand
cuggccaguauugguacaucc

SEQ ID NO: 34018 - RNA, 21 nt, Artificial Sequence
  Marburg virus siRNA sense strand
uggccaguauugguacauccu

SEQ ID NO: 34019 - RNA, 21 nt, Artificial Sequence
  Marburg virus siRNA sense strand
ggccaguauugguacauccuu

SEQ ID NO: 34020 - RNA, 21 nt, Artificial Sequence
  Marburg virus siRNA sense strand
gccaguauugguacauccuuu

SEQ ID NO: 34021 - RNA, 21 nt, Artificial Sequence
  Marburg virus siRNA sense strand
ccaguauugguacauccuuug

SEQ ID NO: 34022 - RNA, 21 nt, Artificial Sequence
  Marburg virus siRNA sense strand
caguauugguacauccuuuga

SEQ ID NO: 34023 - RNA, 21 nt, Artificial Sequence
  Marburg virus siRNA sense strand
aguauugguacauccuuugag

SEQ ID NO: 34024 - RNA, 21 nt, Artificial Sequence
  Marburg virus siRNA sense strand
guauugguacauccuuugaga

SEQ ID NO: 34025 - RNA, 21 nt, Artificial Sequence
  Marburg virus siRNA sense strand
uauugguacauccuuugagag

SEQ ID NO: 34026 - RNA, 21 nt, Artificial Sequence
  Marburg virus siRNA sense strand
auugguacauccuuugagaga

SEQ ID NO: 34027 - RNA, 21 nt, Artificial Sequence
  Marburg virus siRNA sense strand
uugguacauccuuugagagag

SEQ ID NO: 34028 - RNA, 21 nt, Artificial Sequence
  Marburg virus siRNA sense strand
ugguacauccuuugagagagg

SEQ ID NO: 34029 - RNA, 21 nt, Artificial Sequence
  Marburg virus siRNA sense strand
gguacauccuuugagagagga

SEQ ID NO: 34030 - RNA, 21 nt, Artificial Sequence
  Marburg virus siRNA sense strand
guacauccuuugagagaggaa

SEQ ID NO: 34031 - RNA, 21 nt, Artificial Sequence
  Marburg virus siRNA sense strand
uacauccuuugagagaggaac

SEQ ID NO: 34032 - RNA, 21 nt, Artificial Sequence
  Marburg virus siRNA sense strand
acauccuuugagagaggaaca

SEQ ID NO: 34033 - RNA, 21 nt, Artificial Sequence
  Marburg virus siRNA sense strand
cauccuuugagagaggaacaa

SEQ ID NO: 34034 - RNA, 21 nt, Artificial Sequence
  Marburg virus siRNA sense strand
auccuuugagagaggaacaag

SEQ ID NO: 34035 - RNA, 21 nt, Artificial Sequence
  Marburg virus siRNA sense strand
uccuuugagagaggaacaagu

SEQ ID NO: 34036 - RNA, 21 nt, Artificial Sequence
  Marburg virus siRNA sense strand
ccuuugagagaggaacaagug

SEQ ID NO: 34037 - RNA, 21 nt, Artificial Sequence
  Marburg virus siRNA sense strand
cuuugagagaggaacaaguga

SEQ ID NO: 34038 - RNA, 21 nt, Artificial Sequence
  Marburg virus siRNA sense strand
uuugagagaggaacaagugag

SEQ ID NO: 34039 - RNA, 21 nt, Artificial Sequence
  Marburg virus siRNA sense strand
uugagagaggaacaagugaga

SEQ ID NO: 34040 - RNA, 21 nt, Artificial Sequence
  Marburg virus siRNA sense strand
ugagagaggaacaagugagac

SEQ ID NO: 34041 - RNA, 21 nt, Artificial Sequence
  Marburg virus siRNA sense strand
gagagaggaacaagugagaca

SEQ ID NO: 34042 - RNA, 21 nt, Artificial Sequence
  Marburg virus siRNA sense strand
agagaggaacaagugagacac

SEQ ID NO: 34043 - RNA, 21 nt, Artificial Sequence
  Marburg virus siRNA sense strand
gagaggaacaagugagacacg

SEQ ID NO: 34044 - RNA, 21 nt, Artificial Sequence
  Marburg virus siRNA sense strand
agaggaacaagugagacacgg

SEQ ID NO: 34045 - RNA, 21 nt, Artificial Sequence
  Marburg virus siRNA sense strand
gaggaacaagugagacacggc

SEQ ID NO: 34046 - RNA, 21 nt, Artificial Sequence
  Marburg virus siRNA sense strand
aggaacaagugagacacggca

SEQ ID NO: 34047 - RNA, 21 nt, Artificial Sequence
  Marburg virus siRNA sense strand
ggaacaagugagacacggcac

SEQ ID NO: 34048 - RNA, 21 nt, Artificial Sequence
  Marburg virus siRNA sense strand
gaacaagugagacacggcaca

SEQ ID NO: 34049 - RNA, 21 nt, Artificial Sequence
  Marburg virus siRNA sense strand
aacaagugagacacggcacau

SEQ ID NO: 34050 - RNA, 21 nt, Artificial Sequence
  Marburg virus siRNA sense strand
acaagugagacacggcacauu

SEQ ID NO: 34051 - RNA, 21 nt, Artificial Sequence
  Marburg virus siRNA sense strand
caagugagacacggcacauuu

SEQ ID NO: 34052 - RNA, 21 nt, Artificial Sequence
  Marburg virus siRNA sense strand
aagugagacacggcacauuuu

SEQ ID NO: 34053 - RNA, 21 nt, Artificial Sequence
  Marburg virus siRNA sense strand
agugagacacggcacauuuuu

SEQ ID NO: 34054 - RNA, 21 nt, Artificial Sequence
  Marburg virus siRNA sense strand
gugagacacggcacauuuuuc

SEQ ID NO: 34055 - RNA, 21 nt, Artificial Sequence
  Marburg virus siRNA sense strand
ugagacacggcacauuuuucc

SEQ ID NO: 34056 - RNA, 21 nt, Artificial Sequence
  Marburg virus siRNA sense strand
gagacacggcacauuuuuccg

SEQ ID NO: 34057 - RNA, 21 nt, Artificial Sequence
  Marburg virus siRNA sense strand
agacacggcacauuuuuccga

SEQ ID NO: 34058 - RNA, 21 nt, Artificial Sequence
  Marburg virus siRNA sense strand
gacacggcacauuuuuccgag

SEQ ID NO: 34059 - RNA, 21 nt, Artificial Sequence
  Marburg virus siRNA sense strand
acacggcacauuuuuccgagu

SEQ ID NO: 34060 - RNA, 21 nt, Artificial Sequence
  Marburg virus siRNA sense strand
cacggcacauuuuuccgaguc

SEQ ID NO: 34061 - RNA, 21 nt, Artificial Sequence
  Marburg virus siRNA sense strand
acggcacauuuuuccgagucg

SEQ ID NO: 34062 - RNA, 21 nt, Artificial Sequence
  Marburg virus siRNA sense strand
cggcacauuuuuccgagucgu

SEQ ID NO: 34063 - RNA, 21 nt, Artificial Sequence
  Marburg virus siRNA sense strand
ggcacauuuuuccgagucguu

SEQ ID NO: 34064 - RNA, 21 nt, Artificial Sequence
  Marburg virus siRNA sense strand
gcacauuuuuccgagucguug

SEQ ID NO: 34065 - RNA, 21 nt, Artificial Sequence
  Marburg virus siRNA sense strand
cacauuuuuccgagucguugg

SEQ ID NO: 34066 - RNA, 21 nt, Artificial Sequence
  Marburg virus siRNA sense strand
acauuuuuccgagucguugga

SEQ ID NO: 34067 - RNA, 21 nt, Artificial Sequence
  Marburg virus siRNA sense strand
cauuuuuccgagucguuggau

SEQ ID NO: 34068 - RNA, 21 nt, Artificial Sequence
  Marburg virus siRNA sense strand
auuuuuccgagucguuggaua

SEQ ID NO: 34069 - RNA, 21 nt, Artificial Sequence
  Marburg virus siRNA sense strand
uuuuuccgagucguuggauag

SEQ ID NO: 34070 - RNA, 21 nt, Artificial Sequence
  Marburg virus siRNA sense strand
uuuuccgagucguuggauagc

SEQ ID NO: 34071 - RNA, 21 nt, Artificial Sequence
  Marburg virus siRNA sense strand
uuuccgagucguuggauagcu

SEQ ID NO: 34072 - RNA, 21 nt, Artificial Sequence
  Marburg virus siRNA sense strand
uuccgagucguuggauagcuu

SEQ ID NO: 34073 - RNA, 21 nt, Artificial Sequence
  Marburg virus siRNA sense strand
uccgagucguuggauagcuuc

SEQ ID NO: 34074 - RNA, 21 nt, Artificial Sequence
  Marburg virus siRNA sense strand
ccgagucguuggauagcuuca

SEQ ID NO: 34075 - RNA, 21 nt, Artificial Sequence
  Marburg virus siRNA sense strand
cgagucguuggauagcuucau

SEQ ID NO: 34076 - RNA, 21 nt, Artificial Sequence
  Marburg virus siRNA sense strand
gagucguuggauagcuucauu

SEQ ID NO: 34077 - RNA, 21 nt, Artificial Sequence
  Marburg virus siRNA sense strand
agucguuggauagcuucauuu

SEQ ID NO: 34078 - RNA, 21 nt, Artificial Sequence
  Marburg virus siRNA sense strand
gucguuggauagcuucauuuc

SEQ ID NO: 34079 - RNA, 21 nt, Artificial Sequence
  Marburg virus siRNA sense strand
ucguuggauagcuucauuuca

SEQ ID NO: 34080 - RNA, 21 nt, Artificial Sequence
  Marburg virus siRNA sense strand
cguuggauagcuucauuucau

SEQ ID NO: 34081 - RNA, 21 nt, Artificial Sequence
  Marburg virus siRNA sense strand
guuggauagcuucauuucauu

SEQ ID NO: 34082 - RNA, 21 nt, Artificial Sequence
  Marburg virus siRNA sense strand
uuggauagcuucauuucauuc

SEQ ID NO: 34083 - RNA, 21 nt, Artificial Sequence
  Marburg virus siRNA sense strand
uggauagcuucauuucauuca

SEQ ID NO: 34084 - RNA, 21 nt, Artificial Sequence
  Marburg virus siRNA sense strand
ggauagcuucauuucauucaa

SEQ ID NO: 34085 - RNA, 21 nt, Artificial Sequence
  Marburg virus siRNA sense strand
gauagcuucauuucauucaau

SEQ ID NO: 34086 - RNA, 21 nt, Artificial Sequence
  Marburg virus siRNA sense strand
auagcuucauuucauucaaug

SEQ ID NO: 34087 - RNA, 21 nt, Artificial Sequence
  Marburg virus siRNA sense strand
uagcuucauuucauucaaugu

SEQ ID NO: 34088 - RNA, 21 nt, Artificial Sequence
  Marburg virus siRNA sense strand
agcuucauuucauucaauguu

SEQ ID NO: 34089 - RNA, 21 nt, Artificial Sequence
  Marburg virus siRNA sense strand
gcuucauuucauucaauguua

SEQ ID NO: 34090 - RNA, 21 nt, Artificial Sequence
  Marburg virus siRNA sense strand
cuucauuucauucaauguuag

SEQ ID NO: 34091 - RNA, 21 nt, Artificial Sequence
  Marburg virus siRNA sense strand
uucauuucauucaauguuagc

SEQ ID NO: 34092 - RNA, 21 nt, Artificial Sequence
  Marburg virus siRNA sense strand
ucauuucauucaauguuagca

SEQ ID NO: 34093 - RNA, 21 nt, Artificial Sequence
  Marburg virus siRNA sense strand
cauuucauucaauguuagcaa

SEQ ID NO: 34094 - RNA, 21 nt, Artificial Sequence
  Marburg virus siRNA sense strand
auuucauucaauguuagcaau

SEQ ID NO: 34095 - RNA, 21 nt, Artificial Sequence
  Marburg virus siRNA sense strand
uuucauucaauguuagcaaua

SEQ ID NO: 34096 - RNA, 21 nt, Artificial Sequence
  Marburg virus siRNA sense strand
uucauucaauguuagcaauaa

SEQ ID NO: 34097 - RNA, 21 nt, Artificial Sequence
  Marburg virus siRNA sense strand
ucauucaauguuagcaauaaa

SEQ ID NO: 34098 - RNA, 21 nt, Artificial Sequence
  Marburg virus siRNA sense strand
cauucaauguuagcaauaaau

SEQ ID NO: 34099 - RNA, 21 nt, Artificial Sequence
  Marburg virus siRNA sense strand
auucaauguuagcaauaaauu

SEQ ID NO: 34100 - RNA, 21 nt, Artificial Sequence
  Marburg virus siRNA sense strand
uucaauguuagcaauaaauuu

SEQ ID NO: 34101 - RNA, 21 nt, Artificial Sequence
  Marburg virus siRNA sense strand
ucaauguuagcaauaaauuua

SEQ ID NO: 34102 - RNA, 21 nt, Artificial Sequence
  Marburg virus siRNA sense strand
caauguuagcaauaaauuuau

SEQ ID NO: 34103 - RNA, 21 nt, Artificial Sequence
  Marburg virus siRNA sense strand
aauguuagcaauaaauuuauu

SEQ ID NO: 34104 - RNA, 21 nt, Artificial Sequence
  Marburg virus siRNA sense strand
auguuagcaauaaauuuauua

SEQ ID NO: 34105 - RNA, 21 nt, Artificial Sequence
  Marburg virus siRNA sense strand
uguuagcaauaaauuuauuaa

SEQ ID NO: 34106 - RNA, 21 nt, Artificial Sequence
  Marburg virus siRNA sense strand
guuagcaauaaauuuauuaaa

SEQ ID NO: 34107 - RNA, 21 nt, Artificial Sequence
  Marburg virus siRNA sense strand
uuagcaauaaauuuauuaaau

SEQ ID NO: 34108 - RNA, 21 nt, Artificial Sequence
  Marburg virus siRNA sense strand
uagcaauaaauuuauuaaauc

SEQ ID NO: 34109 - RNA, 21 nt, Artificial Sequence
  Marburg virus siRNA sense strand
agcaauaaauuuauuaaauca

SEQ ID NO: 34110 - RNA, 21 nt, Artificial Sequence
  Marburg virus siRNA sense strand
gcaauaaauuuauuaaaucag

SEQ ID NO: 34111 - RNA, 21 nt, Artificial Sequence
  Marburg virus siRNA sense strand
caauaaauuuauuaaaucaga

SEQ ID NO: 34112 - RNA, 21 nt, Artificial Sequence
  Marburg virus siRNA sense strand
aauaaauuuauuaaaucagaa

SEQ ID NO: 34113 - RNA, 21 nt, Artificial Sequence
  Marburg virus siRNA sense strand
auaaauuuauuaaaucagaau

SEQ ID NO: 34114 - RNA, 21 nt, Artificial Sequence
  Marburg virus siRNA sense strand
uaaauuuauuaaaucagaauc

SEQ ID NO: 34115 - RNA, 21 nt, Artificial Sequence
  Marburg virus siRNA sense strand
aaauuuauuaaaucagaauca

SEQ ID NO: 34116 - RNA, 21 nt, Artificial Sequence
  Marburg virus siRNA sense strand
aauuuauuaaaucagaaucac

SEQ ID NO: 34117 - RNA, 21 nt, Artificial Sequence
  Marburg virus siRNA sense strand
auuuauuaaaucagaaucacc

SEQ ID NO: 34118 - RNA, 21 nt, Artificial Sequence
  Marburg virus siRNA sense strand
uuuauuaaaucagaaucaccu

SEQ ID NO: 34119 - RNA, 21 nt, Artificial Sequence
  Marburg virus siRNA sense strand
uuauuaaaucagaaucaccuu

SEQ ID NO: 34120 - RNA, 21 nt, Artificial Sequence
  Marburg virus siRNA sense strand
uauuaaaucagaaucaccuug

SEQ ID NO: 34121 - RNA, 21 nt, Artificial Sequence
  Marburg virus siRNA sense strand
auuaaaucagaaucaccuugg

SEQ ID NO: 34122 - RNA, 21 nt, Artificial Sequence
  Marburg virus siRNA sense strand
uuaaaucagaaucaccuuggg

SEQ ID NO: 34123 - RNA, 21 nt, Artificial Sequence
  Marburg virus siRNA sense strand
uaaaucagaaucaccuugggu

SEQ ID NO: 34124 - RNA, 21 nt, Artificial Sequence
  Marburg virus siRNA sense strand
aaaucagaaucaccuuggguu

SEQ ID NO: 34125 - RNA, 21 nt, Artificial Sequence
  Marburg virus siRNA sense strand
aaucagaaucaccuuggguuu

SEQ ID NO: 34126 - RNA, 21 nt, Artificial Sequence
  Marburg virus siRNA sense strand
aucagaaucaccuuggguuuc

SEQ ID NO: 34127 - RNA, 21 nt, Artificial Sequence
  Marburg virus siRNA sense strand
ucagaaucaccuuggguuucc

SEQ ID NO: 34128 - RNA, 21 nt, Artificial Sequence
  Marburg virus siRNA sense strand
cagaaucaccuuggguuuccc

SEQ ID NO: 34129 - RNA, 21 nt, Artificial Sequence
  Marburg virus siRNA sense strand
agaaucaccuuggguuucccc

SEQ ID NO: 34130 - RNA, 21 nt, Artificial Sequence
  Marburg virus siRNA sense strand
gaaucaccuuggguuuccccu

SEQ ID NO: 34131 - RNA, 21 nt, Artificial Sequence
  Marburg virus siRNA sense strand
aaucaccuuggguuuccccua

SEQ ID NO: 34132 - RNA, 21 nt, Artificial Sequence
  Marburg virus siRNA sense strand
aucaccuuggguuuccccuag

SEQ ID NO: 34133 - RNA, 21 nt, Artificial Sequence
  Marburg virus siRNA sense strand
ucaccuuggguuuccccuagg

SEQ ID NO: 34134 - RNA, 21 nt, Artificial Sequence
  Marburg virus siRNA sense strand
caccuuggguuuccccuaggg

SEQ ID NO: 34135 - RNA, 21 nt, Artificial Sequence
  Marburg virus siRNA sense strand
accuuggguuuccccuagggu

SEQ ID NO: 34136 - RNA, 21 nt, Artificial Sequence
  Marburg virus siRNA sense strand
ccuuggguuuccccuaggguu

SEQ ID NO: 34137 - RNA, 21 nt, Artificial Sequence
  Marburg virus siRNA sense strand
cuuggguuuccccuaggguuc

SEQ ID NO: 34138 - RNA, 21 nt, Artificial Sequence
  Marburg virus siRNA sense strand
uuggguuuccccuaggguuca

SEQ ID NO: 34139 - RNA, 21 nt, Artificial Sequence
  Marburg virus siRNA sense strand
uggguuuccccuaggguucag

SEQ ID NO: 34140 - RNA, 21 nt, Artificial Sequence
  Marburg virus siRNA sense strand
ggguuuccccuaggguucagu

SEQ ID NO: 34141 - RNA, 21 nt, Artificial Sequence
  Marburg virus siRNA sense strand
gguuuccccuaggguucagua

SEQ ID NO: 34142 - RNA, 21 nt, Artificial Sequence
  Marburg virus siRNA sense strand
guuuccccuaggguucaguau

SEQ ID NO: 34143 - RNA, 21 nt, Artificial Sequence
  Marburg virus siRNA sense strand
uuuccccuaggguucaguauu

SEQ ID NO: 34144 - RNA, 21 nt, Artificial Sequence
  Marburg virus siRNA sense strand
uuccccuaggguucaguauug

SEQ ID NO: 34145 - RNA, 21 nt, Artificial Sequence
  Marburg virus siRNA sense strand
uccccuaggguucaguauuga

SEQ ID NO: 34146 - RNA, 21 nt, Artificial Sequence
  Marburg virus siRNA sense strand
ccccuaggguucaguauugau

SEQ ID NO: 34147 - RNA, 21 nt, Artificial Sequence
  Marburg virus siRNA sense strand
cccuaggguucaguauugaua

SEQ ID NO: 34148 - RNA, 21 nt, Artificial Sequence
  Marburg virus siRNA sense strand
ccuaggguucaguauugauau

SEQ ID NO: 34149 - RNA, 21 nt, Artificial Sequence
  Marburg virus siRNA sense strand
cuaggguucaguauugauauu

SEQ ID NO: 34150 - RNA, 21 nt, Artificial Sequence
  Marburg virus siRNA sense strand
uaggguucaguauugauauuu

SEQ ID NO: 34151 - RNA, 21 nt, Artificial Sequence
  Marburg virus siRNA sense strand
aggguucaguauugauauuuc

SEQ ID NO: 34152 - RNA, 21 nt, Artificial Sequence
  Marburg virus siRNA sense strand
ggguucaguauugauauuucu

SEQ ID NO: 34153 - RNA, 21 nt, Artificial Sequence
  Marburg virus siRNA sense strand
gguucaguauugauauuucuu

SEQ ID NO: 34154 - RNA, 21 nt, Artificial Sequence
  Marburg virus siRNA sense strand
guucaguauugauauuucuug

SEQ ID NO: 34155 - RNA, 21 nt, Artificial Sequence
  Marburg virus siRNA sense strand
uucaguauugauauuucuugu

SEQ ID NO: 34156 - RNA, 21 nt, Artificial Sequence
  Marburg virus siRNA sense strand
ucaguauugauauuucuuguu

SEQ ID NO: 34157 - RNA, 21 nt, Artificial Sequence
  Marburg virus siRNA sense strand
caguauugauauuucuuguuu

SEQ ID NO: 34158 - RNA, 21 nt, Artificial Sequence
  Marburg virus siRNA sense strand
aguauugauauuucuuguuuc

SEQ ID NO: 34159 - RNA, 21 nt, Artificial Sequence
  Marburg virus siRNA sense strand
guauugauauuucuuguuuca

SEQ ID NO: 34160 - RNA, 21 nt, Artificial Sequence
  Marburg virus siRNA sense strand
uauugauauuucuuguuucaa

SEQ ID NO: 34161 - RNA, 21 nt, Artificial Sequence
  Marburg virus siRNA sense strand
auugauauuucuuguuucaaa

SEQ ID NO: 34162 - RNA, 21 nt, Artificial Sequence
  Marburg virus siRNA sense strand
uugauauuucuuguuucaaaa

SEQ ID NO: 34163 - RNA, 21 nt, Artificial Sequence
  Marburg virus siRNA sense strand
ugauauuucuuguuucaaaaa

SEQ ID NO: 34164 - RNA, 21 nt, Artificial Sequence
  Marburg virus siRNA sense strand
gauauuucuuguuucaaaaag

SEQ ID NO: 34165 - RNA, 21 nt, Artificial Sequence
  Marburg virus siRNA sense strand
auauuucuuguuucaaaaagc

SEQ ID NO: 34166 - RNA, 21 nt, Artificial Sequence
  Marburg virus siRNA sense strand
uauuucuuguuucaaaaagcc

SEQ ID NO: 34167 - RNA, 21 nt, Artificial Sequence
  Marburg virus siRNA sense strand
auuucuuguuucaaaaagccu

SEQ ID NO: 34168 - RNA, 21 nt, Artificial Sequence
  Marburg virus siRNA sense strand
uuucuuguuucaaaaagccuc

SEQ ID NO: 34169 - RNA, 21 nt, Artificial Sequence
  Marburg virus siRNA sense strand
uucuuguuucaaaaagccucu

SEQ ID NO: 34170 - RNA, 21 nt, Artificial Sequence
  Marburg virus siRNA sense strand
ucuuguuucaaaaagccucuu

SEQ ID NO: 34171 - RNA, 21 nt, Artificial Sequence
  Marburg virus siRNA sense strand
cuuguuucaaaaagccucuua

SEQ ID NO: 34172 - RNA, 21 nt, Artificial Sequence
  Marburg virus siRNA sense strand
uuguuucaaaaagccucuuac

SEQ ID NO: 34173 - RNA, 21 nt, Artificial Sequence
  Marburg virus siRNA sense strand
uguuucaaaaagccucuuacc

SEQ ID NO: 34174 - RNA, 21 nt, Artificial Sequence
  Marburg virus siRNA sense strand
guuucaaaaagccucuuaccu

SEQ ID NO: 34175 - RNA, 21 nt, Artificial Sequence
  Marburg virus siRNA sense strand
uuucaaaaagccucuuaccuu

SEQ ID NO: 34176 - RNA, 21 nt, Artificial Sequence
  Marburg virus siRNA sense strand
uucaaaaagccucuuaccuuu

SEQ ID NO: 34177 - RNA, 21 nt, Artificial Sequence
  Marburg virus siRNA sense strand
ucaaaaagccucuuaccuuuu

SEQ ID NO: 34178 - RNA, 21 nt, Artificial Sequence
  Marburg virus siRNA sense strand
caaaaagccucuuaccuuuuc

SEQ ID NO: 34179 - RNA, 21 nt, Artificial Sequence
  Marburg virus siRNA sense strand
aaaaagccucuuaccuuuucg

SEQ ID NO: 34180 - RNA, 21 nt, Artificial Sequence
  Marburg virus siRNA sense strand
aaaagccucuuaccuuuucgg

SEQ ID NO: 34181 - RNA, 21 nt, Artificial Sequence
  Marburg virus siRNA sense strand
aaagccucuuaccuuuucgga

SEQ ID NO: 34182 - RNA, 21 nt, Artificial Sequence
  Marburg virus siRNA sense strand
aagccucuuaccuuuucggaa

SEQ ID NO: 34183 - RNA, 21 nt, Artificial Sequence
  Marburg virus siRNA sense strand
agccucuuaccuuuucggaaa

SEQ ID NO: 34184 - RNA, 21 nt, Artificial Sequence
  Marburg virus siRNA sense strand
gccucuuaccuuuucggaaaa

SEQ ID NO: 34185 - RNA, 21 nt, Artificial Sequence
  Marburg virus siRNA sense strand
ccucuuaccuuuucggaaaaa

SEQ ID NO: 34186 - RNA, 21 nt, Artificial Sequence
  Marburg virus siRNA sense strand
cucuuaccuuuucggaaaaau

SEQ ID NO: 34187 - RNA, 21 nt, Artificial Sequence
  Marburg virus siRNA sense strand
ucuuaccuuuucggaaaaauu

SEQ ID NO: 34188 - RNA, 21 nt, Artificial Sequence
  Marburg virus siRNA sense strand
cuuaccuuuucggaaaaauua

SEQ ID NO: 34189 - RNA, 21 nt, Artificial Sequence
  Marburg virus siRNA sense strand
uuaccuuuucggaaaaauuaa

SEQ ID NO: 34190 - RNA, 21 nt, Artificial Sequence
  Marburg virus siRNA sense strand
uaccuuuucggaaaaauuaau

SEQ ID NO: 34191 - RNA, 21 nt, Artificial Sequence
  Marburg virus siRNA sense strand
accuuuucggaaaaauuaauu

SEQ ID NO: 34192 - RNA, 21 nt, Artificial Sequence
  Marburg virus siRNA sense strand
ccuuuucggaaaaauuaauug

SEQ ID NO: 34193 - RNA, 21 nt, Artificial Sequence
  Marburg virus siRNA sense strand
cuuuucggaaaaauuaauugc

SEQ ID NO: 34194 - RNA, 21 nt, Artificial Sequence
  Marburg virus siRNA sense strand
uuuucggaaaaauuaauugcu

SEQ ID NO: 34195 - RNA, 21 nt, Artificial Sequence
  Marburg virus siRNA sense strand
uuucggaaaaauuaauugcuc

SEQ ID NO: 34196 - RNA, 21 nt, Artificial Sequence
  Marburg virus siRNA sense strand
uucggaaaaauuaauugcucu

SEQ ID NO: 34197 - RNA, 21 nt, Artificial Sequence
  Marburg virus siRNA sense strand
ucggaaaaauuaauugcucuu

SEQ ID NO: 34198 - RNA, 21 nt, Artificial Sequence
  Marburg virus siRNA sense strand
cggaaaaauuaauugcucuua

SEQ ID NO: 34199 - RNA, 21 nt, Artificial Sequence
  Marburg virus siRNA sense strand
ggaaaaauuaauugcucuuau

SEQ ID NO: 34200 - RNA, 21 nt, Artificial Sequence
  Marburg virus siRNA sense strand
gaaaaauuaauugcucuuaua

SEQ ID NO: 34201 - RNA, 21 nt, Artificial Sequence
  Marburg virus siRNA sense strand
aaaaauuaauugcucuuauaa

SEQ ID NO: 34202 - RNA, 21 nt, Artificial Sequence
  Marburg virus siRNA sense strand
aaaauuaauugcucuuauaac

SEQ ID NO: 34203 - RNA, 21 nt, Artificial Sequence
  Marburg virus siRNA sense strand
aaauuaauugcucuuauaacg

SEQ ID NO: 34204 - RNA, 21 nt, Artificial Sequence
  Marburg virus siRNA sense strand
aauuaauugcucuuauaacgc

SEQ ID NO: 34205 - RNA, 21 nt, Artificial Sequence
  Marburg virus siRNA sense strand
auuaauugcucuuauaacgcc

SEQ ID NO: 34206 - RNA, 21 nt, Artificial Sequence
  Marburg virus siRNA sense strand
uuaauugcucuuauaacgccc

SEQ ID NO: 34207 - RNA, 21 nt, Artificial Sequence
  Marburg virus siRNA sense strand
uaauugcucuuauaacgcccc

SEQ ID NO: 34208 - RNA, 21 nt, Artificial Sequence
  Marburg virus siRNA sense strand
aauugcucuuauaacgcccca

SEQ ID NO: 34209 - RNA, 21 nt, Artificial Sequence
  Marburg virus siRNA sense strand
auugcucuuauaacgccccaa

SEQ ID NO: 34210 - RNA, 21 nt, Artificial Sequence
  Marburg virus siRNA sense strand
uugcucuuauaacgccccaag

SEQ ID NO: 34211 - RNA, 21 nt, Artificial Sequence
  Marburg virus siRNA sense strand
ugcucuuauaacgccccaagu

SEQ ID NO: 34212 - RNA, 21 nt, Artificial Sequence
  Marburg virus siRNA sense strand
gcucuuauaacgccccaaguu

SEQ ID NO: 34213 - RNA, 21 nt, Artificial Sequence
  Marburg virus siRNA sense strand
cucuuauaacgccccaaguuc

SEQ ID NO: 34214 - RNA, 21 nt, Artificial Sequence
  Marburg virus siRNA sense strand
ucuuauaacgccccaaguucu

SEQ ID NO: 34215 - RNA, 21 nt, Artificial Sequence
  Marburg virus siRNA sense strand
cuuauaacgccccaaguucua

SEQ ID NO: 34216 - RNA, 21 nt, Artificial Sequence
  Marburg virus siRNA sense strand
uuauaacgccccaaguucuag

SEQ ID NO: 34217 - RNA, 21 nt, Artificial Sequence
  Marburg virus siRNA sense strand
uauaacgccccaaguucuagg

SEQ ID NO: 34218 - RNA, 21 nt, Artificial Sequence
  Marburg virus siRNA sense strand
auaacgccccaaguucuagga

SEQ ID NO: 34219 - RNA, 21 nt, Artificial Sequence
  Marburg virus siRNA sense strand
uaacgccccaaguucuaggag

SEQ ID NO: 34220 - RNA, 21 nt, Artificial Sequence
  Marburg virus siRNA sense strand
aacgccccaaguucuaggagg

SEQ ID NO: 34221 - RNA, 21 nt, Artificial Sequence
  Marburg virus siRNA sense strand
acgccccaaguucuaggaggg

SEQ ID NO: 34222 - RNA, 21 nt, Artificial Sequence
  Marburg virus siRNA sense strand
cgccccaaguucuaggagggu

SEQ ID NO: 34223 - RNA, 21 nt, Artificial Sequence
  Marburg virus siRNA sense strand
gccccaaguucuaggaggguu

SEQ ID NO: 34224 - RNA, 21 nt, Artificial Sequence
  Marburg virus siRNA sense strand
ccccaaguucuaggaggguua

SEQ ID NO: 34225 - RNA, 21 nt, Artificial Sequence
  Marburg virus siRNA sense strand
cccaaguucuaggaggguuau

SEQ ID NO: 34226 - RNA, 21 nt, Artificial Sequence
  Marburg virus siRNA sense strand
ccaaguucuaggaggguuauc

SEQ ID NO: 34227 - RNA, 21 nt, Artificial Sequence
  Marburg virus siRNA sense strand
caaguucuaggaggguuauca

SEQ ID NO: 34228 - RNA, 21 nt, Artificial Sequence
  Marburg virus siRNA sense strand
aaguucuaggaggguuaucau

SEQ ID NO: 34229 - RNA, 21 nt, Artificial Sequence
  Marburg virus siRNA sense strand
aguucuaggaggguuaucauu

SEQ ID NO: 34230 - RNA, 21 nt, Artificial Sequence
  Marburg virus siRNA sense strand
guucuaggaggguuaucauuu

SEQ ID NO: 34231 - RNA, 21 nt, Artificial Sequence
  Marburg virus siRNA sense strand
uucuaggaggguuaucauuuu

SEQ ID NO: 34232 - RNA, 21 nt, Artificial Sequence
  Marburg virus siRNA sense strand
ucuaggaggguuaucauuuuu

SEQ ID NO: 34233 - RNA, 21 nt, Artificial Sequence
  Marburg virus siRNA sense strand
cuaggaggguuaucauuuuug

SEQ ID NO: 34234 - RNA, 21 nt, Artificial Sequence
  Marburg virus siRNA sense strand
uaggaggguuaucauuuuuga

SEQ ID NO: 34235 - RNA, 21 nt, Artificial Sequence
  Marburg virus siRNA sense strand
aggaggguuaucauuuuugaa

SEQ ID NO: 34236 - RNA, 21 nt, Artificial Sequence
  Marburg virus siRNA sense strand
ggaggguuaucauuuuugaau

SEQ ID NO: 34237 - RNA, 21 nt, Artificial Sequence
  Marburg virus siRNA sense strand
gaggguuaucauuuuugaauc

SEQ ID NO: 34238 - RNA, 21 nt, Artificial Sequence
  Marburg virus siRNA sense strand
aggguuaucauuuuugaaucc

SEQ ID NO: 34239 - RNA, 21 nt, Artificial Sequence
  Marburg virus siRNA sense strand
ggguuaucauuuuugaauccg

SEQ ID NO: 34240 - RNA, 21 nt, Artificial Sequence
  Marburg virus siRNA sense strand
gguuaucauuuuugaauccgg

SEQ ID NO: 34241 - RNA, 21 nt, Artificial Sequence
  Marburg virus siRNA sense strand
guuaucauuuuugaauccgga

SEQ ID NO: 34242 - RNA, 21 nt, Artificial Sequence
  Marburg virus siRNA sense strand
uuaucauuuuugaauccggag

SEQ ID NO: 34243 - RNA, 21 nt, Artificial Sequence
  Marburg virus siRNA sense strand
uaucauuuuugaauccggaga

SEQ ID NO: 34244 - RNA, 21 nt, Artificial Sequence
  Marburg virus siRNA sense strand
aucauuuuugaauccggagaa

SEQ ID NO: 34245 - RNA, 21 nt, Artificial Sequence
  Marburg virus siRNA sense strand
ucauuuuugaauccggagaaa

SEQ ID NO: 34246 - RNA, 21 nt, Artificial Sequence
  Marburg virus siRNA sense strand
cauuuuugaauccggagaaau

SEQ ID NO: 34247 - RNA, 21 nt, Artificial Sequence
  Marburg virus siRNA sense strand
auuuuugaauccggagaaauu

SEQ ID NO: 34248 - RNA, 21 nt, Artificial Sequence
  Marburg virus siRNA sense strand
uuuuugaauccggagaaauug

SEQ ID NO: 34249 - RNA, 21 nt, Artificial Sequence
  Marburg virus siRNA sense strand
uuuugaauccggagaaauugu

SEQ ID NO: 34250 - RNA, 21 nt, Artificial Sequence
  Marburg virus siRNA sense strand
uuugaauccggagaaauuguu

SEQ ID NO: 34251 - RNA, 21 nt, Artificial Sequence
  Marburg virus siRNA sense strand
uugaauccggagaaauuguuc

SEQ ID NO: 34252 - RNA, 21 nt, Artificial Sequence
  Marburg virus siRNA sense strand
ugaauccggagaaauuguucu

SEQ ID NO: 34253 - RNA, 21 nt, Artificial Sequence
  Marburg virus siRNA sense strand
gaauccggagaaauuguucua

SEQ ID NO: 34254 - RNA, 21 nt, Artificial Sequence
  Marburg virus siRNA sense strand
aauccggagaaauuguucuac

SEQ ID NO: 34255 - RNA, 21 nt, Artificial Sequence
  Marburg virus siRNA sense strand
auccggagaaauuguucuacc

SEQ ID NO: 34256 - RNA, 21 nt, Artificial Sequence
  Marburg virus siRNA sense strand
uccggagaaauuguucuaccg

SEQ ID NO: 34257 - RNA, 21 nt, Artificial Sequence
  Marburg virus siRNA sense strand
ccggagaaauuguucuaccgg

SEQ ID NO: 34258 - RNA, 21 nt, Artificial Sequence
  Marburg virus siRNA sense strand
cggagaaauuguucuaccgga

SEQ ID NO: 34259 - RNA, 21 nt, Artificial Sequence
  Marburg virus siRNA sense strand
ggagaaauuguucuaccggaa

SEQ ID NO: 34260 - RNA, 21 nt, Artificial Sequence
  Marburg virus siRNA sense strand
gagaaauuguucuaccggaac

SEQ ID NO: 34261 - RNA, 21 nt, Artificial Sequence
  Marburg virus siRNA sense strand
agaaauuguucuaccggaaca

SEQ ID NO: 34262 - RNA, 21 nt, Artificial Sequence
  Marburg virus siRNA sense strand
gaaauuguucuaccggaacau

SEQ ID NO: 34263 - RNA, 21 nt, Artificial Sequence
  Marburg virus siRNA sense strand
aaauuguucuaccggaacaua

SEQ ID NO: 34264 - RNA, 21 nt, Artificial Sequence
  Marburg virus siRNA sense strand
aauuguucuaccggaacauaa

SEQ ID NO: 34265 - RNA, 21 nt, Artificial Sequence
  Marburg virus siRNA sense strand
auuguucuaccggaacauaag

SEQ ID NO: 34266 - RNA, 21 nt, Artificial Sequence
  Marburg virus siRNA sense strand
uuguucuaccggaacauaagu

SEQ ID NO: 34267 - RNA, 21 nt, Artificial Sequence
  Marburg virus siRNA sense strand
uguucuaccggaacauaagug

SEQ ID NO: 34268 - RNA, 21 nt, Artificial Sequence
  Marburg virus siRNA sense strand
guucuaccggaacauaaguga

SEQ ID NO: 34269 - RNA, 21 nt, Artificial Sequence
  Marburg virus siRNA sense strand
uucuaccggaacauaagugau

SEQ ID NO: 34270 - RNA, 21 nt, Artificial Sequence
  Marburg virus siRNA sense strand
ucuaccggaacauaagugauc

SEQ ID NO: 34271 - RNA, 21 nt, Artificial Sequence
  Marburg virus siRNA sense strand
cuaccggaacauaagugaucc

SEQ ID NO: 34272 - RNA, 21 nt, Artificial Sequence
  Marburg virus siRNA sense strand
uaccggaacauaagugauccg

SEQ ID NO: 34273 - RNA, 21 nt, Artificial Sequence
  Marburg virus siRNA sense strand
accggaacauaagugauccgc

SEQ ID NO: 34274 - RNA, 21 nt, Artificial Sequence
  Marburg virus siRNA sense strand
ccggaacauaagugauccgcu

SEQ ID NO: 34275 - RNA, 21 nt, Artificial Sequence
  Marburg virus siRNA sense strand
cggaacauaagugauccgcuc

SEQ ID NO: 34276 - RNA, 21 nt, Artificial Sequence
  Marburg virus siRNA sense strand
ggaacauaagugauccgcuca

SEQ ID NO: 34277 - RNA, 21 nt, Artificial Sequence
  Marburg virus siRNA sense strand
gaacauaagugauccgcucac

SEQ ID NO: 34278 - RNA, 21 nt, Artificial Sequence
  Marburg virus siRNA sense strand
aacauaagugauccgcucacu

SEQ ID NO: 34279 - RNA, 21 nt, Artificial Sequence
  Marburg virus siRNA sense strand
acauaagugauccgcucacuu

SEQ ID NO: 34280 - RNA, 21 nt, Artificial Sequence
  Marburg virus siRNA sense strand
cauaagugauccgcucacuuc

SEQ ID NO: 34281 - RNA, 21 nt, Artificial Sequence
  Marburg virus siRNA sense strand
auaagugauccgcucacuucg

SEQ ID NO: 34282 - RNA, 21 nt, Artificial Sequence
  Marburg virus siRNA sense strand
uaagugauccgcucacuucgg

SEQ ID NO: 34283 - RNA, 21 nt, Artificial Sequence
  Marburg virus siRNA sense strand
aagugauccgcucacuucggg

SEQ ID NO: 34284 - RNA, 21 nt, Artificial Sequence
  Marburg virus siRNA sense strand
agugauccgcucacuucgggu

SEQ ID NO: 34285 - RNA, 21 nt, Artificial Sequence
  Marburg virus siRNA sense strand
gugauccgcucacuucggguc

SEQ ID NO: 34286 - RNA, 21 nt, Artificial Sequence
  Marburg virus siRNA sense strand
ugauccgcucacuucgggucu

SEQ ID NO: 34287 - RNA, 21 nt, Artificial Sequence
  Marburg virus siRNA sense strand
gauccgcucacuucgggucua

SEQ ID NO: 34288 - RNA, 21 nt, Artificial Sequence
  Marburg virus siRNA sense strand
auccgcucacuucgggucuau

SEQ ID NO: 34289 - RNA, 21 nt, Artificial Sequence
  Marburg virus siRNA sense strand
uccgcucacuucgggucuauu

SEQ ID NO: 34290 - RNA, 21 nt, Artificial Sequence
  Marburg virus siRNA sense strand
ccgcucacuucgggucuauuu

SEQ ID NO: 34291 - RNA, 21 nt, Artificial Sequence
  Marburg virus siRNA sense strand
cgcucacuucgggucuauuuc

SEQ ID NO: 34292 - RNA, 21 nt, Artificial Sequence
  Marburg virus siRNA sense strand
gcucacuucgggucuauuuca

SEQ ID NO: 34293 - RNA, 21 nt, Artificial Sequence
  Marburg virus siRNA sense strand
cucacuucgggucuauuucaa

SEQ ID NO: 34294 - RNA, 21 nt, Artificial Sequence
  Marburg virus siRNA sense strand
ucacuucgggucuauuucaac

SEQ ID NO: 34295 - RNA, 21 nt, Artificial Sequence
  Marburg virus siRNA sense strand
cacuucgggucuauuucaacu

SEQ ID NO: 34296 - RNA, 21 nt, Artificial Sequence
  Marburg virus siRNA sense strand
acuucgggucuauuucaacuu

SEQ ID NO: 34297 - RNA, 21 nt, Artificial Sequence
  Marburg virus siRNA sense strand
cuucgggucuauuucaacuua

SEQ ID NO: 34298 - RNA, 21 nt, Artificial Sequence
  Marburg virus siRNA sense strand
uucgggucuauuucaacuuaa

SEQ ID NO: 34299 - RNA, 21 nt, Artificial Sequence
  Marburg virus siRNA sense strand
ucgggucuauuucaacuuaag

SEQ ID NO: 34300 - RNA, 21 nt, Artificial Sequence
  Marburg virus siRNA sense strand
cgggucuauuucaacuuaaga

SEQ ID NO: 34301 - RNA, 21 nt, Artificial Sequence
  Marburg virus siRNA sense strand
gggucuauuucaacuuaagaa

SEQ ID NO: 34302 - RNA, 21 nt, Artificial Sequence
  Marburg virus siRNA sense strand
ggucuauuucaacuuaagaau

SEQ ID NO: 34303 - RNA, 21 nt, Artificial Sequence
  Marburg virus siRNA sense strand
gucuauuucaacuuaagaaug

SEQ ID NO: 34304 - RNA, 21 nt, Artificial Sequence
  Marburg virus siRNA sense strand
ucuauuucaacuuaagaaugc

SEQ ID NO: 34305 - RNA, 21 nt, Artificial Sequence
  Marburg virus siRNA sense strand
cuauuucaacuuaagaaugca

SEQ ID NO: 34306 - RNA, 21 nt, Artificial Sequence
  Marburg virus siRNA sense strand
uauuucaacuuaagaaugcau

SEQ ID NO: 34307 - RNA, 21 nt, Artificial Sequence
  Marburg virus siRNA sense strand
auuucaacuuaagaaugcauu

SEQ ID NO: 34308 - RNA, 21 nt, Artificial Sequence
  Marburg virus siRNA sense strand
uuucaacuuaagaaugcauua

SEQ ID NO: 34309 - RNA, 21 nt, Artificial Sequence
  Marburg virus siRNA sense strand
uucaacuuaagaaugcauuag

SEQ ID NO: 34310 - RNA, 21 nt, Artificial Sequence
  Marburg virus siRNA sense strand
ucaacuuaagaaugcauuaga

SEQ ID NO: 34311 - RNA, 21 nt, Artificial Sequence
  Marburg virus siRNA sense strand
caacuuaagaaugcauuagaa

SEQ ID NO: 34312 - RNA, 21 nt, Artificial Sequence
  Marburg virus siRNA sense strand
aacuuaagaaugcauuagaau

SEQ ID NO: 34313 - RNA, 21 nt, Artificial Sequence
  Marburg virus siRNA sense strand
acuuaagaaugcauuagaauu

SEQ ID NO: 34314 - RNA, 21 nt, Artificial Sequence
  Marburg virus siRNA sense strand
cuuaagaaugcauuagaauuu

SEQ ID NO: 34315 - RNA, 21 nt, Artificial Sequence
  Marburg virus siRNA sense strand
uuaagaaugcauuagaauuuc

SEQ ID NO: 34316 - RNA, 21 nt, Artificial Sequence
  Marburg virus siRNA sense strand
uaagaaugcauuagaauuucu

SEQ ID NO: 34317 - RNA, 21 nt, Artificial Sequence
  Marburg virus siRNA sense strand
aagaaugcauuagaauuucuu

SEQ ID NO: 34318 - RNA, 21 nt, Artificial Sequence
  Marburg virus siRNA sense strand
agaaugcauuagaauuucuug

SEQ ID NO: 34319 - RNA, 21 nt, Artificial Sequence
  Marburg virus siRNA sense strand
gaaugcauuagaauuucuuga

SEQ ID NO: 34320 - RNA, 21 nt, Artificial Sequence
  Marburg virus siRNA sense strand
aaugcauuagaauuucuugaa

SEQ ID NO: 34321 - RNA, 21 nt, Artificial Sequence
  Marburg virus siRNA sense strand
augcauuagaauuucuugaaa

SEQ ID NO: 34322 - RNA, 21 nt, Artificial Sequence
  Marburg virus siRNA sense strand
ugcauuagaauuucuugaaaa

SEQ ID NO: 34323 - RNA, 21 nt, Artificial Sequence
  Marburg virus siRNA sense strand
gcauuagaauuucuugaaaag

SEQ ID NO: 34324 - RNA, 21 nt, Artificial Sequence
  Marburg virus siRNA sense strand
cauuagaauuucuugaaaagg

SEQ ID NO: 34325 - RNA, 21 nt, Artificial Sequence
  Marburg virus siRNA sense strand
auuagaauuucuugaaaagga

SEQ ID NO: 34326 - RNA, 21 nt, Artificial Sequence
  Marburg virus siRNA sense strand
uuagaauuucuugaaaaggaa

SEQ ID NO: 34327 - RNA, 21 nt, Artificial Sequence
  Marburg virus siRNA sense strand
uagaauuucuugaaaaggaag

SEQ ID NO: 34328 - RNA, 21 nt, Artificial Sequence
  Marburg virus siRNA sense strand
agaauuucuugaaaaggaaga

SEQ ID NO: 34329 - RNA, 21 nt, Artificial Sequence
  Marburg virus siRNA sense strand
gaauuucuugaaaaggaagaa

SEQ ID NO: 34330 - RNA, 21 nt, Artificial Sequence
  Marburg virus siRNA sense strand
aauuucuugaaaaggaagaau

SEQ ID NO: 34331 - RNA, 21 nt, Artificial Sequence
  Marburg virus siRNA sense strand
auuucuugaaaaggaagaauu

SEQ ID NO: 34332 - RNA, 21 nt, Artificial Sequence
  Marburg virus siRNA sense strand
uuucuugaaaaggaagaauua

SEQ ID NO: 34333 - RNA, 21 nt, Artificial Sequence
  Marburg virus siRNA sense strand
uucuugaaaaggaagaauuau

SEQ ID NO: 34334 - RNA, 21 nt, Artificial Sequence
  Marburg virus siRNA sense strand
ucuugaaaaggaagaauuauu

SEQ ID NO: 34335 - RNA, 21 nt, Artificial Sequence
  Marburg virus siRNA sense strand
cuugaaaaggaagaauuauuc

SEQ ID NO: 34336 - RNA, 21 nt, Artificial Sequence
  Marburg virus siRNA sense strand
uugaaaaggaagaauuauucu

SEQ ID NO: 34337 - RNA, 21 nt, Artificial Sequence
  Marburg virus siRNA sense strand
ugaaaaggaagaauuauucua

SEQ ID NO: 34338 - RNA, 21 nt, Artificial Sequence
  Marburg virus siRNA sense strand
gaaaaggaagaauuauucuau

SEQ ID NO: 34339 - RNA, 21 nt, Artificial Sequence
  Marburg virus siRNA sense strand
aaaaggaagaauuauucuaua

SEQ ID NO: 34340 - RNA, 21 nt, Artificial Sequence
  Marburg virus siRNA sense strand
aaaggaagaauuauucuauau

SEQ ID NO: 34341 - RNA, 21 nt, Artificial Sequence
  Marburg virus siRNA sense strand
aaggaagaauuauucuauauc

SEQ ID NO: 34342 - RNA, 21 nt, Artificial Sequence
  Marburg virus siRNA sense strand
aggaagaauuauucuauaucu

SEQ ID NO: 34343 - RNA, 21 nt, Artificial Sequence
  Marburg virus siRNA sense strand
ggaagaauuauucuauaucuu

SEQ ID NO: 34344 - RNA, 21 nt, Artificial Sequence
  Marburg virus siRNA sense strand
gaagaauuauucuauaucuug

SEQ ID NO: 34345 - RNA, 21 nt, Artificial Sequence
  Marburg virus siRNA sense strand
aagaauuauucuauaucuuga

SEQ ID NO: 34346 - RNA, 21 nt, Artificial Sequence
  Marburg virus siRNA sense strand
agaauuauucuauaucuugau

SEQ ID NO: 34347 - RNA, 21 nt, Artificial Sequence
  Marburg virus siRNA sense strand
gaauuauucuauaucuugauu

SEQ ID NO: 34348 - RNA, 21 nt, Artificial Sequence
  Marburg virus siRNA sense strand
aauuauucuauaucuugauug

SEQ ID NO: 34349 - RNA, 21 nt, Artificial Sequence
  Marburg virus siRNA sense strand
auuauucuauaucuugauugc

SEQ ID NO: 34350 - RNA, 21 nt, Artificial Sequence
  Marburg virus siRNA sense strand
uuauucuauaucuugauugcu

SEQ ID NO: 34351 - RNA, 21 nt, Artificial Sequence
  Marburg virus siRNA sense strand
uauucuauaucuugauugcua

SEQ ID NO: 34352 - RNA, 21 nt, Artificial Sequence
  Marburg virus siRNA sense strand
auucuauaucuugauugcuaa

SEQ ID NO: 34353 - RNA, 21 nt, Artificial Sequence
  Marburg virus siRNA sense strand
uucuauaucuugauugcuaaa

SEQ ID NO: 34354 - RNA, 21 nt, Artificial Sequence
  Marburg virus siRNA sense strand
ucuauaucuugauugcuaaaa

SEQ ID NO: 34355 - RNA, 21 nt, Artificial Sequence
  Marburg virus siRNA sense strand
cuauaucuugauugcuaaaaa

SEQ ID NO: 34356 - RNA, 21 nt, Artificial Sequence
  Marburg virus siRNA sense strand
uauaucuugauugcuaaaaaa

SEQ ID NO: 34357 - RNA, 21 nt, Artificial Sequence
  Marburg virus siRNA sense strand
auaucuugauugcuaaaaaac

SEQ ID NO: 34358 - RNA, 21 nt, Artificial Sequence
  Marburg virus siRNA sense strand
uaucuugauugcuaaaaaacc

SEQ ID NO: 34359 - RNA, 21 nt, Artificial Sequence
  Marburg virus siRNA sense strand
aucuugauugcuaaaaaaccu

SEQ ID NO: 34360 - RNA, 21 nt, Artificial Sequence
  Marburg virus siRNA sense strand
ucuugauugcuaaaaaaccug

SEQ ID NO: 34361 - RNA, 21 nt, Artificial Sequence
  Marburg virus siRNA sense strand
cuugauugcuaaaaaaccugg

SEQ ID NO: 34362 - RNA, 21 nt, Artificial Sequence
  Marburg virus siRNA sense strand
uugauugcuaaaaaaccuggu

SEQ ID NO: 34363 - RNA, 21 nt, Artificial Sequence
  Marburg virus siRNA sense strand
ugauugcuaaaaaaccugguu

SEQ ID NO: 34364 - RNA, 21 nt, Artificial Sequence
  Marburg virus siRNA sense strand
gauugcuaaaaaaccugguuu

SEQ ID NO: 34365 - RNA, 21 nt, Artificial Sequence
  Marburg virus siRNA sense strand
auugcuaaaaaaccugguuua

SEQ ID NO: 34366 - RNA, 21 nt, Artificial Sequence
  Marburg virus siRNA sense strand
uugcuaaaaaaccugguuuag

SEQ ID NO: 34367 - RNA, 21 nt, Artificial Sequence
  Marburg virus siRNA sense strand
ugcuaaaaaaccugguuuagc

SEQ ID NO: 34368 - RNA, 21 nt, Artificial Sequence
  Marburg virus siRNA sense strand
gcuaaaaaaccugguuuagca

SEQ ID NO: 34369 - RNA, 21 nt, Artificial Sequence
  Marburg virus siRNA sense strand
cuaaaaaaccugguuuagcag

SEQ ID NO: 34370 - RNA, 21 nt, Artificial Sequence
  Marburg virus siRNA sense strand
uaaaaaaccugguuuagcaga

SEQ ID NO: 34371 - RNA, 21 nt, Artificial Sequence
  Marburg virus siRNA sense strand
aaaaaaccugguuuagcagau

SEQ ID NO: 34372 - RNA, 21 nt, Artificial Sequence
  Marburg virus siRNA sense strand
aaaaaccugguuuagcagaug

SEQ ID NO: 34373 - RNA, 21 nt, Artificial Sequence
  Marburg virus siRNA sense strand
aaaaccugguuuagcagaugc

SEQ ID NO: 34374 - RNA, 21 nt, Artificial Sequence
  Marburg virus siRNA sense strand
aaaccugguuuagcagaugcc

SEQ ID NO: 34375 - RNA, 21 nt, Artificial Sequence
  Marburg virus siRNA sense strand
aaccugguuuagcagaugccu

SEQ ID NO: 34376 - RNA, 21 nt, Artificial Sequence
  Marburg virus siRNA sense strand
accugguuuagcagaugccuc

SEQ ID NO: 34377 - RNA, 21 nt, Artificial Sequence
  Marburg virus siRNA sense strand
ccugguuuagcagaugccuca

SEQ ID NO: 34378 - RNA, 21 nt, Artificial Sequence
  Marburg virus siRNA sense strand
cugguuuagcagaugccucag

SEQ ID NO: 34379 - RNA, 21 nt, Artificial Sequence
  Marburg virus siRNA sense strand
ugguuuagcagaugccucaga

SEQ ID NO: 34380 - RNA, 21 nt, Artificial Sequence
  Marburg virus siRNA sense strand
gguuuagcagaugccucagau

SEQ ID NO: 34381 - RNA, 21 nt, Artificial Sequence
  Marburg virus siRNA sense strand
guuuagcagaugccucagauu

SEQ ID NO: 34382 - RNA, 21 nt, Artificial Sequence
  Marburg virus siRNA sense strand
uuuagcagaugccucagauuu

SEQ ID NO: 34383 - RNA, 21 nt, Artificial Sequence
  Marburg virus siRNA sense strand
uuagcagaugccucagauuuc

SEQ ID NO: 34384 - RNA, 21 nt, Artificial Sequence
  Marburg virus siRNA sense strand
uagcagaugccucagauuucg

SEQ ID NO: 34385 - RNA, 21 nt, Artificial Sequence
  Marburg virus siRNA sense strand
agcagaugccucagauuucgu

SEQ ID NO: 34386 - RNA, 21 nt, Artificial Sequence
  Marburg virus siRNA sense strand
gcagaugccucagauuucguc

SEQ ID NO: 34387 - RNA, 21 nt, Artificial Sequence
  Marburg virus siRNA sense strand
cagaugccucagauuucguca

SEQ ID NO: 34388 - RNA, 21 nt, Artificial Sequence
  Marburg virus siRNA sense strand
agaugccucagauuucgucau

SEQ ID NO: 34389 - RNA, 21 nt, Artificial Sequence
  Marburg virus siRNA sense strand
gaugccucagauuucgucaug

SEQ ID NO: 34390 - RNA, 21 nt, Artificial Sequence
  Marburg virus siRNA sense strand
augccucagauuucgucauga

SEQ ID NO: 34391 - RNA, 21 nt, Artificial Sequence
  Marburg virus siRNA sense strand
ugccucagauuucgucaugaa

SEQ ID NO: 34392 - RNA, 21 nt, Artificial Sequence
  Marburg virus siRNA sense strand
gccucagauuucgucaugaau

SEQ ID NO: 34393 - RNA, 21 nt, Artificial Sequence
  Marburg virus siRNA sense strand
ccucagauuucgucaugaauc

SEQ ID NO: 34394 - RNA, 21 nt, Artificial Sequence
  Marburg virus siRNA sense strand
cucagauuucgucaugaaucc

SEQ ID NO: 34395 - RNA, 21 nt, Artificial Sequence
  Marburg virus siRNA sense strand
ucagauuucgucaugaaucca

SEQ ID NO: 34396 - RNA, 21 nt, Artificial Sequence
  Marburg virus siRNA sense strand
cagauuucgucaugaauccau

SEQ ID NO: 34397 - RNA, 21 nt, Artificial Sequence
  Marburg virus siRNA sense strand
agauuucgucaugaauccauu

SEQ ID NO: 34398 - RNA, 21 nt, Artificial Sequence
  Marburg virus siRNA sense strand
gauuucgucaugaauccauua

SEQ ID NO: 34399 - RNA, 21 nt, Artificial Sequence
  Marburg virus siRNA sense strand
auuucgucaugaauccauuag

SEQ ID NO: 34400 - RNA, 21 nt, Artificial Sequence
  Marburg virus siRNA sense strand
uuucgucaugaauccauuagg

SEQ ID NO: 34401 - RNA, 21 nt, Artificial Sequence
  Marburg virus siRNA sense strand
uucgucaugaauccauuaggc

SEQ ID NO: 34402 - RNA, 21 nt, Artificial Sequence
  Marburg virus siRNA sense strand
ucgucaugaauccauuaggcu

SEQ ID NO: 34403 - RNA, 21 nt, Artificial Sequence
  Marburg virus siRNA sense strand
cgucaugaauccauuaggcuu

SEQ ID NO: 34404 - RNA, 21 nt, Artificial Sequence
  Marburg virus siRNA sense strand
gucaugaauccauuaggcuua

SEQ ID NO: 34405 - RNA, 21 nt, Artificial Sequence
  Marburg virus siRNA sense strand
ucaugaauccauuaggcuuaa

SEQ ID NO: 34406 - RNA, 21 nt, Artificial Sequence
  Marburg virus siRNA sense strand
caugaauccauuaggcuuaaa

SEQ ID NO: 34407 - RNA, 21 nt, Artificial Sequence
  Marburg virus siRNA sense strand
augaauccauuaggcuuaaau

SEQ ID NO: 34408 - RNA, 21 nt, Artificial Sequence
  Marburg virus siRNA sense strand
ugaauccauuaggcuuaaaug

SEQ ID NO: 34409 - RNA, 21 nt, Artificial Sequence
  Marburg virus siRNA sense strand
gaauccauuaggcuuaaaugu

SEQ ID NO: 34410 - RNA, 21 nt, Artificial Sequence
  Marburg virus siRNA sense strand
aauccauuaggcuuaaaugua

SEQ ID NO: 34411 - RNA, 21 nt, Artificial Sequence
  Marburg virus siRNA sense strand
auccauuaggcuuaaauguac

SEQ ID NO: 34412 - RNA, 21 nt, Artificial Sequence
  Marburg virus siRNA sense strand
uccauuaggcuuaaauguacc

SEQ ID NO: 34413 - RNA, 21 nt, Artificial Sequence
  Marburg virus siRNA sense strand
ccauuaggcuuaaauguacca

SEQ ID NO: 34414 - RNA, 21 nt, Artificial Sequence
  Marburg virus siRNA sense strand
cauuaggcuuaaauguaccag

SEQ ID NO: 34415 - RNA, 21 nt, Artificial Sequence
  Marburg virus siRNA sense strand
auuaggcuuaaauguaccagg

SEQ ID NO: 34416 - RNA, 21 nt, Artificial Sequence
  Marburg virus siRNA sense strand
uuaggcuuaaauguaccagga

SEQ ID NO: 34417 - RNA, 21 nt, Artificial Sequence
  Marburg virus siRNA sense strand
uaggcuuaaauguaccaggau

SEQ ID NO: 34418 - RNA, 21 nt, Artificial Sequence
  Marburg virus siRNA sense strand
aggcuuaaauguaccaggauc

SEQ ID NO: 34419 - RNA, 21 nt, Artificial Sequence
  Marburg virus siRNA sense strand
ggcuuaaauguaccaggauca

SEQ ID NO: 34420 - RNA, 21 nt, Artificial Sequence
  Marburg virus siRNA sense strand
gcuuaaauguaccaggaucaa

SEQ ID NO: 34421 - RNA, 21 nt, Artificial Sequence
  Marburg virus siRNA sense strand
cuuaaauguaccaggaucaag

SEQ ID NO: 34422 - RNA, 21 nt, Artificial Sequence
  Marburg virus siRNA sense strand
uuaaauguaccaggaucaagg

SEQ ID NO: 34423 - RNA, 21 nt, Artificial Sequence
  Marburg virus siRNA sense strand
uaaauguaccaggaucaaggg

SEQ ID NO: 34424 - RNA, 21 nt, Artificial Sequence
  Marburg virus siRNA sense strand
aaauguaccaggaucaaggga

SEQ ID NO: 34425 - RNA, 21 nt, Artificial Sequence
  Marburg virus siRNA sense strand
aauguaccaggaucaagggaa

SEQ ID NO: 34426 - RNA, 21 nt, Artificial Sequence
  Marburg virus siRNA sense strand
auguaccaggaucaagggaaa

SEQ ID NO: 34427 - RNA, 21 nt, Artificial Sequence
  Marburg virus siRNA sense strand
uguaccaggaucaagggaaau

SEQ ID NO: 34428 - RNA, 21 nt, Artificial Sequence
  Marburg virus siRNA sense strand
guaccaggaucaagggaaaua

SEQ ID NO: 34429 - RNA, 21 nt, Artificial Sequence
  Marburg virus siRNA sense strand
uaccaggaucaagggaaauaa

SEQ ID NO: 34430 - RNA, 21 nt, Artificial Sequence
  Marburg virus siRNA sense strand
accaggaucaagggaaauaau

SEQ ID NO: 34431 - RNA, 21 nt, Artificial Sequence
  Marburg virus siRNA sense strand
ccaggaucaagggaaauaaua

SEQ ID NO: 34432 - RNA, 21 nt, Artificial Sequence
  Marburg virus siRNA sense strand
caggaucaagggaaauaauaa

SEQ ID NO: 34433 - RNA, 21 nt, Artificial Sequence
  Marburg virus siRNA sense strand
aggaucaagggaaauaauaac

SEQ ID NO: 34434 - RNA, 21 nt, Artificial Sequence
  Marburg virus siRNA sense strand
ggaucaagggaaauaauaacg

SEQ ID NO: 34435 - RNA, 21 nt, Artificial Sequence
  Marburg virus siRNA sense strand
gaucaagggaaauaauaacgu

SEQ ID NO: 34436 - RNA, 21 nt, Artificial Sequence
  Marburg virus siRNA sense strand
aucaagggaaauaauaacguu

SEQ ID NO: 34437 - RNA, 21 nt, Artificial Sequence
  Marburg virus siRNA sense strand
ucaagggaaauaauaacguuc

SEQ ID NO: 34438 - RNA, 21 nt, Artificial Sequence
  Marburg virus siRNA sense strand
caagggaaauaauaacguucc

SEQ ID NO: 34439 - RNA, 21 nt, Artificial Sequence
  Marburg virus siRNA sense strand
aagggaaauaauaacguuccu

SEQ ID NO: 34440 - RNA, 21 nt, Artificial Sequence
  Marburg virus siRNA sense strand
agggaaauaauaacguuccuu

SEQ ID NO: 34441 - RNA, 21 nt, Artificial Sequence
  Marburg virus siRNA sense strand
gggaaauaauaacguuccuua

SEQ ID NO: 34442 - RNA, 21 nt, Artificial Sequence
  Marburg virus siRNA sense strand
ggaaauaauaacguuccuuag

SEQ ID NO: 34443 - RNA, 21 nt, Artificial Sequence
  Marburg virus siRNA sense strand
gaaauaauaacguuccuuaga

SEQ ID NO: 34444 - RNA, 21 nt, Artificial Sequence
  Marburg virus siRNA sense strand
aaauaauaacguuccuuagac

SEQ ID NO: 34445 - RNA, 21 nt, Artificial Sequence
  Marburg virus siRNA sense strand
aauaauaacguuccuuagaca

SEQ ID NO: 34446 - RNA, 21 nt, Artificial Sequence
  Marburg virus siRNA sense strand
auaauaacguuccuuagacaa

SEQ ID NO: 34447 - RNA, 21 nt, Artificial Sequence
  Marburg virus siRNA sense strand
uaauaacguuccuuagacaaa

SEQ ID NO: 34448 - RNA, 21 nt, Artificial Sequence
  Marburg virus siRNA sense strand
aauaacguuccuuagacaaac

SEQ ID NO: 34449 - RNA, 21 nt, Artificial Sequence
  Marburg virus siRNA sense strand
auaacguuccuuagacaaaca

SEQ ID NO: 34450 - RNA, 21 nt, Artificial Sequence
  Marburg virus siRNA sense strand
uaacguuccuuagacaaacag

SEQ ID NO: 34451 - RNA, 21 nt, Artificial Sequence
  Marburg virus siRNA sense strand
aacguuccuuagacaaacagu

SEQ ID NO: 34452 - RNA, 21 nt, Artificial Sequence
  Marburg virus siRNA sense strand
acguuccuuagacaaacaguu

SEQ ID NO: 34453 - RNA, 21 nt, Artificial Sequence
  Marburg virus siRNA sense strand
cguuccuuagacaaacaguuc

SEQ ID NO: 34454 - RNA, 21 nt, Artificial Sequence
  Marburg virus siRNA sense strand
guuccuuagacaaacaguucg

SEQ ID NO: 34455 - RNA, 21 nt, Artificial Sequence
  Marburg virus siRNA sense strand
uuccuuagacaaacaguucgu

SEQ ID NO: 34456 - RNA, 21 nt, Artificial Sequence
  Marburg virus siRNA sense strand
uccuuagacaaacaguucgug

SEQ ID NO: 34457 - RNA, 21 nt, Artificial Sequence
  Marburg virus siRNA sense strand
ccuuagacaaacaguucguga

SEQ ID NO: 34458 - RNA, 21 nt, Artificial Sequence
  Marburg virus siRNA sense strand
cuuagacaaacaguucgugaa

SEQ ID NO: 34459 - RNA, 21 nt, Artificial Sequence
  Marburg virus siRNA sense strand
uuagacaaacaguucgugaaa

SEQ ID NO: 34460 - RNA, 21 nt, Artificial Sequence
  Marburg virus siRNA sense strand
uagacaaacaguucgugaaaa

SEQ ID NO: 34461 - RNA, 21 nt, Artificial Sequence
  Marburg virus siRNA sense strand
agacaaacaguucgugaaaau

SEQ ID NO: 34462 - RNA, 21 nt, Artificial Sequence
  Marburg virus siRNA sense strand
gacaaacaguucgugaaaaua

SEQ ID NO: 34463 - RNA, 21 nt, Artificial Sequence
  Marburg virus siRNA sense strand
acaaacaguucgugaaaauau

SEQ ID NO: 34464 - RNA, 21 nt, Artificial Sequence
  Marburg virus siRNA sense strand
caaacaguucgugaaaauauc

SEQ ID NO: 34465 - RNA, 21 nt, Artificial Sequence
  Marburg virus siRNA sense strand
aaacaguucgugaaaauauca

SEQ ID NO: 34466 - RNA, 21 nt, Artificial Sequence
  Marburg virus siRNA sense strand
aacaguucgugaaaauaucac

SEQ ID NO: 34467 - RNA, 21 nt, Artificial Sequence
  Marburg virus siRNA sense strand
acaguucgugaaaauaucacg

SEQ ID NO: 34468 - RNA, 21 nt, Artificial Sequence
  Marburg virus siRNA sense strand
caguucgugaaaauaucacga

SEQ ID NO: 34469 - RNA, 21 nt, Artificial Sequence
  Marburg virus siRNA sense strand
aguucgugaaaauaucacgau

SEQ ID NO: 34470 - RNA, 21 nt, Artificial Sequence
  Marburg virus siRNA sense strand
guucgugaaaauaucacgauc

SEQ ID NO: 34471 - RNA, 21 nt, Artificial Sequence
  Marburg virus siRNA sense strand
uucgugaaaauaucacgauca

SEQ ID NO: 34472 - RNA, 21 nt, Artificial Sequence
  Marburg virus siRNA sense strand
ucgugaaaauaucacgaucac

SEQ ID NO: 34473 - RNA, 21 nt, Artificial Sequence
  Marburg virus siRNA sense strand
cgugaaaauaucacgaucacg

SEQ ID NO: 34474 - RNA, 21 nt, Artificial Sequence
  Marburg virus siRNA sense strand
gugaaaauaucacgaucacgu

SEQ ID NO: 34475 - RNA, 21 nt, Artificial Sequence
  Marburg virus siRNA sense strand
ugaaaauaucacgaucacguc

SEQ ID NO: 34476 - RNA, 21 nt, Artificial Sequence
  Marburg virus siRNA sense strand
gaaaauaucacgaucacguca

SEQ ID NO: 34477 - RNA, 21 nt, Artificial Sequence
  Marburg virus siRNA sense strand
aaaauaucacgaucacgucac

SEQ ID NO: 34478 - RNA, 21 nt, Artificial Sequence
  Marburg virus siRNA sense strand
aaauaucacgaucacgucaca

SEQ ID NO: 34479 - RNA, 21 nt, Artificial Sequence
  Marburg virus siRNA sense strand
aauaucacgaucacgucacaa

SEQ ID NO: 34480 - RNA, 21 nt, Artificial Sequence
  Marburg virus siRNA sense strand
auaucacgaucacgucacaaa

SEQ ID NO: 34481 - RNA, 21 nt, Artificial Sequence
  Marburg virus siRNA sense strand
uaucacgaucacgucacaaaa

SEQ ID NO: 34482 - RNA, 21 nt, Artificial Sequence
  Marburg virus siRNA sense strand
aucacgaucacgucacaaaau

SEQ ID NO: 34483 - RNA, 21 nt, Artificial Sequence
  Marburg virus siRNA sense strand
ucacgaucacgucacaaaaua

SEQ ID NO: 34484 - RNA, 21 nt, Artificial Sequence
  Marburg virus siRNA sense strand
cacgaucacgucacaaaauag

SEQ ID NO: 34485 - RNA, 21 nt, Artificial Sequence
  Marburg virus siRNA sense strand
acgaucacgucacaaaauaga

SEQ ID NO: 34486 - RNA, 21 nt, Artificial Sequence
  Marburg virus siRNA sense strand
cgaucacgucacaaaauagaa

SEQ ID NO: 34487 - RNA, 21 nt, Artificial Sequence
  Marburg virus siRNA sense strand
gaucacgucacaaaauagaau

SEQ ID NO: 34488 - RNA, 21 nt, Artificial Sequence
  Marburg virus siRNA sense strand
aucacgucacaaaauagaaua

SEQ ID NO: 34489 - RNA, 21 nt, Artificial Sequence
  Marburg virus siRNA sense strand
ucacgucacaaaauagaauaa

SEQ ID NO: 34490 - RNA, 21 nt, Artificial Sequence
  Marburg virus siRNA sense strand
cacgucacaaaauagaauaau

SEQ ID NO: 34491 - RNA, 21 nt, Artificial Sequence
  Marburg virus siRNA sense strand
acgucacaaaauagaauaaua

SEQ ID NO: 34492 - RNA, 21 nt, Artificial Sequence
  Marburg virus siRNA sense strand
cgucacaaaauagaauaauaa

SEQ ID NO: 34493 - RNA, 21 nt, Artificial Sequence
  Marburg virus siRNA sense strand
gucacaaaauagaauaauaaa

SEQ ID NO: 34494 - RNA, 21 nt, Artificial Sequence
  Marburg virus siRNA sense strand
ucacaaaauagaauaauaaau

SEQ ID NO: 34495 - RNA, 21 nt, Artificial Sequence
  Marburg virus siRNA sense strand
cacaaaauagaauaauaaauu

SEQ ID NO: 34496 - RNA, 21 nt, Artificial Sequence
  Marburg virus siRNA sense strand
acaaaauagaauaauaaauuc

SEQ ID NO: 34497 - RNA, 21 nt, Artificial Sequence
  Marburg virus siRNA sense strand
caaaauagaauaauaaauucc

SEQ ID NO: 34498 - RNA, 21 nt, Artificial Sequence
  Marburg virus siRNA sense strand
aaaauagaauaauaaauuccc

SEQ ID NO: 34499 - RNA, 21 nt, Artificial Sequence
  Marburg virus siRNA sense strand
aaauagaauaauaaauucccu

SEQ ID NO: 34500 - RNA, 21 nt, Artificial Sequence
  Marburg virus siRNA sense strand
aauagaauaauaaauucccuu

SEQ ID NO: 34501 - RNA, 21 nt, Artificial Sequence
  Marburg virus siRNA sense strand
auagaauaauaaauucccuuu

SEQ ID NO: 34502 - RNA, 21 nt, Artificial Sequence
  Marburg virus siRNA sense strand
uagaauaauaaauucccuuuu

SEQ ID NO: 34503 - RNA, 21 nt, Artificial Sequence
  Marburg virus siRNA sense strand
agaauaauaaauucccuuuuu

SEQ ID NO: 34504 - RNA, 21 nt, Artificial Sequence
  Marburg virus siRNA sense strand
gaauaauaaauucccuuuuuc

SEQ ID NO: 34505 - RNA, 21 nt, Artificial Sequence
  Marburg virus siRNA sense strand
aauaauaaauucccuuuuuca

SEQ ID NO: 34506 - RNA, 21 nt, Artificial Sequence
  Marburg virus siRNA sense strand
auaauaaauucccuuuuucac

SEQ ID NO: 34507 - RNA, 21 nt, Artificial Sequence
  Marburg virus siRNA sense strand
uaauaaauucccuuuuucaca

SEQ ID NO: 34508 - RNA, 21 nt, Artificial Sequence
  Marburg virus siRNA sense strand
aauaaauucccuuuuucacau

SEQ ID NO: 34509 - RNA, 21 nt, Artificial Sequence
  Marburg virus siRNA sense strand
auaaauucccuuuuucacaua

SEQ ID NO: 34510 - RNA, 21 nt, Artificial Sequence
  Marburg virus siRNA sense strand
uaaauucccuuuuucacauag

SEQ ID NO: 34511 - RNA, 21 nt, Artificial Sequence
  Marburg virus siRNA sense strand
aaauucccuuuuucacauagg

SEQ ID NO: 34512 - RNA, 21 nt, Artificial Sequence
  Marburg virus siRNA sense strand
aauucccuuuuucacauaggu

SEQ ID NO: 34513 - RNA, 21 nt, Artificial Sequence
  Marburg virus siRNA sense strand
auucccuuuuucacauagguu

SEQ ID NO: 34514 - RNA, 21 nt, Artificial Sequence
  Marburg virus siRNA sense strand
uucccuuuuucacauagguuc

SEQ ID NO: 34515 - RNA, 21 nt, Artificial Sequence
  Marburg virus siRNA sense strand
ucccuuuuucacauagguucu

SEQ ID NO: 34516 - RNA, 21 nt, Artificial Sequence
  Marburg virus siRNA sense strand
cccuuuuucacauagguucug

SEQ ID NO: 34517 - RNA, 21 nt, Artificial Sequence
  Marburg virus siRNA sense strand
ccuuuuucacauagguucuga

SEQ ID NO: 34518 - RNA, 21 nt, Artificial Sequence
  Marburg virus siRNA sense strand
cuuuuucacauagguucugau

SEQ ID NO: 34519 - RNA, 21 nt, Artificial Sequence
  Marburg virus siRNA sense strand
uuuuucacauagguucugauu

SEQ ID NO: 34520 - RNA, 21 nt, Artificial Sequence
  Marburg virus siRNA sense strand
uuuucacauagguucugauuu

SEQ ID NO: 34521 - RNA, 21 nt, Artificial Sequence
  Marburg virus siRNA sense strand
uuucacauagguucugauuua

SEQ ID NO: 34522 - RNA, 21 nt, Artificial Sequence
  Marburg virus siRNA sense strand
uucacauagguucugauuuag

SEQ ID NO: 34523 - RNA, 21 nt, Artificial Sequence
  Marburg virus siRNA sense strand
ucacauagguucugauuuaga

SEQ ID NO: 34524 - RNA, 21 nt, Artificial Sequence
  Marburg virus siRNA sense strand
cacauagguucugauuuagag

SEQ ID NO: 34525 - RNA, 21 nt, Artificial Sequence
  Marburg virus siRNA sense strand
acauagguucugauuuagagg

SEQ ID NO: 34526 - RNA, 21 nt, Artificial Sequence
  Marburg virus siRNA sense strand
cauagguucugauuuagagga

SEQ ID NO: 34527 - RNA, 21 nt, Artificial Sequence
  Marburg virus siRNA sense strand
auagguucugauuuagaggac

SEQ ID NO: 34528 - RNA, 21 nt, Artificial Sequence
  Marburg virus siRNA sense strand
uagguucugauuuagaggacc

SEQ ID NO: 34529 - RNA, 21 nt, Artificial Sequence
  Marburg virus siRNA sense strand
agguucugauuuagaggacca

SEQ ID NO: 34530 - RNA, 21 nt, Artificial Sequence
  Marburg virus siRNA sense strand
gguucugauuuagaggaccaa

SEQ ID NO: 34531 - RNA, 21 nt, Artificial Sequence
  Marburg virus siRNA sense strand
guucugauuuagaggaccaaa

SEQ ID NO: 34532 - RNA, 21 nt, Artificial Sequence
  Marburg virus siRNA sense strand
uucugauuuagaggaccaaag

SEQ ID NO: 34533 - RNA, 21 nt, Artificial Sequence
  Marburg virus siRNA sense strand
ucugauuuagaggaccaaagg

SEQ ID NO: 34534 - RNA, 21 nt, Artificial Sequence
  Marburg virus siRNA sense strand
cugauuuagaggaccaaaggg

SEQ ID NO: 34535 - RNA, 21 nt, Artificial Sequence
  Marburg virus siRNA sense strand
ugauuuagaggaccaaagggu

SEQ ID NO: 34536 - RNA, 21 nt, Artificial Sequence
  Marburg virus siRNA sense strand
gauuuagaggaccaaagggug

SEQ ID NO: 34537 - RNA, 21 nt, Artificial Sequence
  Marburg virus siRNA sense strand
auuuagaggaccaaagggugu

SEQ ID NO: 34538 - RNA, 21 nt, Artificial Sequence
  Marburg virus siRNA sense strand
uuuagaggaccaaagggugug

SEQ ID NO: 34539 - RNA, 21 nt, Artificial Sequence
  Marburg virus siRNA sense strand
uuagaggaccaaagggugugu

SEQ ID NO: 34540 - RNA, 21 nt, Artificial Sequence
  Marburg virus siRNA sense strand
uagaggaccaaagggugugug

SEQ ID NO: 34541 - RNA, 21 nt, Artificial Sequence
  Marburg virus siRNA sense strand
agaggaccaaaggguguguga

SEQ ID NO: 34542 - RNA, 21 nt, Artificial Sequence
  Marburg virus siRNA sense strand
gaggaccaaagggugugugag

SEQ ID NO: 34543 - RNA, 21 nt, Artificial Sequence
  Marburg virus siRNA sense strand
aggaccaaagggugugugagu

SEQ ID NO: 34544 - RNA, 21 nt, Artificial Sequence
  Marburg virus siRNA sense strand
ggaccaaagggugugugagug

SEQ ID NO: 34545 - RNA, 21 nt, Artificial Sequence
  Marburg virus siRNA sense strand
gaccaaagggugugugagugg

SEQ ID NO: 34546 - RNA, 21 nt, Artificial Sequence
  Marburg virus siRNA sense strand
accaaagggugugugaguggc

SEQ ID NO: 34547 - RNA, 21 nt, Artificial Sequence
  Marburg virus siRNA sense strand
ccaaagggugugugaguggcu

SEQ ID NO: 34548 - RNA, 21 nt, Artificial Sequence
  Marburg virus siRNA sense strand
caaagggugugugaguggcuu

SEQ ID NO: 34549 - RNA, 21 nt, Artificial Sequence
  Marburg virus siRNA sense strand
aaagggugugugaguggcuuu

SEQ ID NO: 34550 - RNA, 21 nt, Artificial Sequence
  Marburg virus siRNA sense strand
aagggugugugaguggcuuuu

SEQ ID NO: 34551 - RNA, 21 nt, Artificial Sequence
  Marburg virus siRNA sense strand
agggugugugaguggcuuuua

SEQ ID NO: 34552 - RNA, 21 nt, Artificial Sequence
  Marburg virus siRNA sense strand
gggugugugaguggcuuuuau

SEQ ID NO: 34553 - RNA, 21 nt, Artificial Sequence
  Marburg virus siRNA sense strand
ggugugugaguggcuuuuauc

SEQ ID NO: 34554 - RNA, 21 nt, Artificial Sequence
  Marburg virus siRNA sense strand
gugugugaguggcuuuuauca

SEQ ID NO: 34555 - RNA, 21 nt, Artificial Sequence
  Marburg virus siRNA sense strand
ugugugaguggcuuuuaucau

SEQ ID NO: 34556 - RNA, 21 nt, Artificial Sequence
  Marburg virus siRNA sense strand
gugugaguggcuuuuaucauc

SEQ ID NO: 34557 - RNA, 21 nt, Artificial Sequence
  Marburg virus siRNA sense strand
ugugaguggcuuuuaucauca

SEQ ID NO: 34558 - RNA, 21 nt, Artificial Sequence
  Marburg virus siRNA sense strand
gugaguggcuuuuaucaucaa

SEQ ID NO: 34559 - RNA, 21 nt, Artificial Sequence
  Marburg virus siRNA sense strand
ugaguggcuuuuaucaucaaa

SEQ ID NO: 34560 - RNA, 21 nt, Artificial Sequence
  Marburg virus siRNA sense strand
gaguggcuuuuaucaucaaac

SEQ ID NO: 34561 - RNA, 21 nt, Artificial Sequence
  Marburg virus siRNA sense strand
aguggcuuuuaucaucaaacc

SEQ ID NO: 34562 - RNA, 21 nt, Artificial Sequence
  Marburg virus siRNA sense strand
guggcuuuuaucaucaaaccc

SEQ ID NO: 34563 - RNA, 21 nt, Artificial Sequence
  Marburg virus siRNA sense strand
uggcuuuuaucaucaaacccc

SEQ ID NO: 34564 - RNA, 21 nt, Artificial Sequence
  Marburg virus siRNA sense strand
ggcuuuuaucaucaaaccccg

SEQ ID NO: 34565 - RNA, 21 nt, Artificial Sequence
  Marburg virus siRNA sense strand
gcuuuuaucaucaaaccccgu

SEQ ID NO: 34566 - RNA, 21 nt, Artificial Sequence
  Marburg virus siRNA sense strand
cuuuuaucaucaaaccccgua

SEQ ID NO: 34567 - RNA, 21 nt, Artificial Sequence
  Marburg virus siRNA sense strand
uuuuaucaucaaaccccguaa

SEQ ID NO: 34568 - RNA, 21 nt, Artificial Sequence
  Marburg virus siRNA sense strand
uuuaucaucaaaccccguaau

SEQ ID NO: 34569 - RNA, 21 nt, Artificial Sequence
  Marburg virus siRNA sense strand
uuaucaucaaaccccguaaug

SEQ ID NO: 34570 - RNA, 21 nt, Artificial Sequence
  Marburg virus siRNA sense strand
uaucaucaaaccccguaauga

SEQ ID NO: 34571 - RNA, 21 nt, Artificial Sequence
  Marburg virus siRNA sense strand
aucaucaaaccccguaaugag

SEQ ID NO: 34572 - RNA, 21 nt, Artificial Sequence
  Marburg virus siRNA sense strand
ucaucaaaccccguaaugagu

SEQ ID NO: 34573 - RNA, 21 nt, Artificial Sequence
  Marburg virus siRNA sense strand
caucaaaccccguaaugaguc

SEQ ID NO: 34574 - RNA, 21 nt, Artificial Sequence
  Marburg virus siRNA sense strand
aucaaaccccguaaugagucg

SEQ ID NO: 34575 - RNA, 21 nt, Artificial Sequence
  Marburg virus siRNA sense strand
ucaaaccccguaaugagucga

SEQ ID NO: 34576 - RNA, 21 nt, Artificial Sequence
  Marburg virus siRNA sense strand
caaaccccguaaugagucgau

SEQ ID NO: 34577 - RNA, 21 nt, Artificial Sequence
  Marburg virus siRNA sense strand
aaaccccguaaugagucgauu

SEQ ID NO: 34578 - RNA, 21 nt, Artificial Sequence
  Marburg virus siRNA sense strand
aaccccguaaugagucgauuu

SEQ ID NO: 34579 - RNA, 21 nt, Artificial Sequence
  Marburg virus siRNA sense strand
accccguaaugagucgauuug

SEQ ID NO: 34580 - RNA, 21 nt, Artificial Sequence
  Marburg virus siRNA sense strand
ccccguaaugagucgauuugc

SEQ ID NO: 34581 - RNA, 21 nt, Artificial Sequence
  Marburg virus siRNA sense strand
cccguaaugagucgauuugcu

SEQ ID NO: 34582 - RNA, 21 nt, Artificial Sequence
  Marburg virus siRNA sense strand
ccguaaugagucgauuugcug

SEQ ID NO: 34583 - RNA, 21 nt, Artificial Sequence
  Marburg virus siRNA sense strand
cguaaugagucgauuugcugc

SEQ ID NO: 34584 - RNA, 21 nt, Artificial Sequence
  Marburg virus siRNA sense strand
guaaugagucgauuugcugcu

SEQ ID NO: 34585 - RNA, 21 nt, Artificial Sequence
  Marburg virus siRNA sense strand
uaaugagucgauuugcugcug

SEQ ID NO: 34586 - RNA, 21 nt, Artificial Sequence
  Marburg virus siRNA sense strand
aaugagucgauuugcugcuga

SEQ ID NO: 34587 - RNA, 21 nt, Artificial Sequence
  Marburg virus siRNA sense strand
augagucgauuugcugcugac

SEQ ID NO: 34588 - RNA, 21 nt, Artificial Sequence
  Marburg virus siRNA sense strand
ugagucgauuugcugcugaca

SEQ ID NO: 34589 - RNA, 21 nt, Artificial Sequence
  Marburg virus siRNA sense strand
gagucgauuugcugcugacau

SEQ ID NO: 34590 - RNA, 21 nt, Artificial Sequence
  Marburg virus siRNA sense strand
agucgauuugcugcugacauc

SEQ ID NO: 34591 - RNA, 21 nt, Artificial Sequence
  Marburg virus siRNA sense strand
gucgauuugcugcugacaucu

SEQ ID NO: 34592 - RNA, 21 nt, Artificial Sequence
  Marburg virus siRNA sense strand
ucgauuugcugcugacaucuu

SEQ ID NO: 34593 - RNA, 21 nt, Artificial Sequence
  Marburg virus siRNA sense strand
cgauuugcugcugacaucuuu

SEQ ID NO: 34594 - RNA, 21 nt, Artificial Sequence
  Marburg virus siRNA sense strand
gauuugcugcugacaucuuuu

SEQ ID NO: 34595 - RNA, 21 nt, Artificial Sequence
  Marburg virus siRNA sense strand
auuugcugcugacaucuuuuc

SEQ ID NO: 34596 - RNA, 21 nt, Artificial Sequence
  Marburg virus siRNA sense strand
uuugcugcugacaucuuuuca

SEQ ID NO: 34597 - RNA, 21 nt, Artificial Sequence
  Marburg virus siRNA sense strand
uugcugcugacaucuuuucaa

SEQ ID NO: 34598 - RNA, 21 nt, Artificial Sequence
  Marburg virus siRNA sense strand
ugcugcugacaucuuuucaag

SEQ ID NO: 34599 - RNA, 21 nt, Artificial Sequence
  Marburg virus siRNA sense strand
gcugcugacaucuuuucaaga

SEQ ID NO: 34600 - RNA, 21 nt, Artificial Sequence
  Marburg virus siRNA sense strand
cugcugacaucuuuucaagaa

SEQ ID NO: 34601 - RNA, 21 nt, Artificial Sequence
  Marburg virus siRNA sense strand
ugcugacaucuuuucaagaac

SEQ ID NO: 34602 - RNA, 21 nt, Artificial Sequence
  Marburg virus siRNA sense strand
gcugacaucuuuucaagaacg

SEQ ID NO: 34603 - RNA, 21 nt, Artificial Sequence
  Marburg virus siRNA sense strand
cugacaucuuuucaagaacgc

SEQ ID NO: 34604 - RNA, 21 nt, Artificial Sequence
  Marburg virus siRNA sense strand
ugacaucuuuucaagaacgcc

SEQ ID NO: 34605 - RNA, 21 nt, Artificial Sequence
  Marburg virus siRNA sense strand
gacaucuuuucaagaacgccu

SEQ ID NO: 34606 - RNA, 21 nt, Artificial Sequence
  Marburg virus siRNA sense strand
acaucuuuucaagaacgccua

SEQ ID NO: 34607 - RNA, 21 nt, Artificial Sequence
  Marburg virus siRNA sense strand
caucuuuucaagaacgccuag

SEQ ID NO: 34608 - RNA, 21 nt, Artificial Sequence
  Marburg virus siRNA sense strand
aucuuuucaagaacgccuagu

SEQ ID NO: 34609 - RNA, 21 nt, Artificial Sequence
  Marburg virus siRNA sense strand
ucuuuucaagaacgccuagug

SEQ ID NO: 34610 - RNA, 21 nt, Artificial Sequence
  Marburg virus siRNA sense strand
cuuuucaagaacgccuagugg

SEQ ID NO: 34611 - RNA, 21 nt, Artificial Sequence
  Marburg virus siRNA sense strand
uuuucaagaacgccuagugga

SEQ ID NO: 34612 - RNA, 21 nt, Artificial Sequence
  Marburg virus siRNA sense strand
uuucaagaacgccuaguggaa

SEQ ID NO: 34613 - RNA, 21 nt, Artificial Sequence
  Marburg virus siRNA sense strand
uucaagaacgccuaguggaaa

SEQ ID NO: 34614 - RNA, 21 nt, Artificial Sequence
  Marburg virus siRNA sense strand
ucaagaacgccuaguggaaaa

SEQ ID NO: 34615 - RNA, 21 nt, Artificial Sequence
  Marburg virus siRNA sense strand
caagaacgccuaguggaaaac

SEQ ID NO: 34616 - RNA, 21 nt, Artificial Sequence
  Marburg virus siRNA sense strand
aagaacgccuaguggaaaacg

SEQ ID NO: 34617 - RNA, 21 nt, Artificial Sequence
  Marburg virus siRNA sense strand
agaacgccuaguggaaaacgg

SEQ ID NO: 34618 - RNA, 21 nt, Artificial Sequence
  Marburg virus siRNA sense strand
gaacgccuaguggaaaacggc

SEQ ID NO: 34619 - RNA, 21 nt, Artificial Sequence
  Marburg virus siRNA sense strand
aacgccuaguggaaaacggcu

SEQ ID NO: 34620 - RNA, 21 nt, Artificial Sequence
  Marburg virus siRNA sense strand
acgccuaguggaaaacggcuu

SEQ ID NO: 34621 - RNA, 21 nt, Artificial Sequence
  Marburg virus siRNA sense strand
cgccuaguggaaaacggcuuc

SEQ ID NO: 34622 - RNA, 21 nt, Artificial Sequence
  Marburg virus siRNA sense strand
gccuaguggaaaacggcuuca

SEQ ID NO: 34623 - RNA, 21 nt, Artificial Sequence
  Marburg virus siRNA sense strand
ccuaguggaaaacggcuucag

SEQ ID NO: 34624 - RNA, 21 nt, Artificial Sequence
  Marburg virus siRNA sense strand
cuaguggaaaacggcuucagg

SEQ ID NO: 34625 - RNA, 21 nt, Artificial Sequence
  Marburg virus siRNA sense strand
uaguggaaaacggcuucaggu

SEQ ID NO: 34626 - RNA, 21 nt, Artificial Sequence
  Marburg virus siRNA sense strand
aguggaaaacggcuucagguc

SEQ ID NO: 34627 - RNA, 21 nt, Artificial Sequence
  Marburg virus siRNA sense strand
guggaaaacggcuucaggucu

SEQ ID NO: 34628 - RNA, 21 nt, Artificial Sequence
  Marburg virus siRNA sense strand
uggaaaacggcuucaggucuu

SEQ ID NO: 34629 - RNA, 21 nt, Artificial Sequence
  Marburg virus siRNA sense strand
ggaaaacggcuucaggucuua

SEQ ID NO: 34630 - RNA, 21 nt, Artificial Sequence
  Marburg virus siRNA sense strand
gaaaacggcuucaggucuuag

SEQ ID NO: 34631 - RNA, 21 nt, Artificial Sequence
  Marburg virus siRNA sense strand
aaaacggcuucaggucuuagg

SEQ ID NO: 34632 - RNA, 21 nt, Artificial Sequence
  Marburg virus siRNA sense strand
aaacggcuucaggucuuaggc

SEQ ID NO: 34633 - RNA, 21 nt, Artificial Sequence
  Marburg virus siRNA sense strand
aacggcuucaggucuuaggcu

SEQ ID NO: 34634 - RNA, 21 nt, Artificial Sequence
  Marburg virus siRNA sense strand
acggcuucaggucuuaggcua

SEQ ID NO: 34635 - RNA, 21 nt, Artificial Sequence
  Marburg virus siRNA sense strand
cggcuucaggucuuaggcuau

SEQ ID NO: 34636 - RNA, 21 nt, Artificial Sequence
  Marburg virus siRNA sense strand
ggcuucaggucuuaggcuauc

SEQ ID NO: 34637 - RNA, 21 nt, Artificial Sequence
  Marburg virus siRNA sense strand
gcuucaggucuuaggcuaucu

SEQ ID NO: 34638 - RNA, 21 nt, Artificial Sequence
  Marburg virus siRNA sense strand
cuucaggucuuaggcuaucug

SEQ ID NO: 34639 - RNA, 21 nt, Artificial Sequence
  Marburg virus siRNA sense strand
uucaggucuuaggcuaucugg

SEQ ID NO: 34640 - RNA, 21 nt, Artificial Sequence
  Marburg virus siRNA sense strand
ucaggucuuaggcuaucugga

SEQ ID NO: 34641 - RNA, 21 nt, Artificial Sequence
  Marburg virus siRNA sense strand
caggucuuaggcuaucuggaa

SEQ ID NO: 34642 - RNA, 21 nt, Artificial Sequence
  Marburg virus siRNA sense strand
aggucuuaggcuaucuggaag

SEQ ID NO: 34643 - RNA, 21 nt, Artificial Sequence
  Marburg virus siRNA sense strand
ggucuuaggcuaucuggaagg

SEQ ID NO: 34644 - RNA, 21 nt, Artificial Sequence
  Marburg virus siRNA sense strand
gucuuaggcuaucuggaagga

SEQ ID NO: 34645 - RNA, 21 nt, Artificial Sequence
  Marburg virus siRNA sense strand
ucuuaggcuaucuggaaggaa

SEQ ID NO: 34646 - RNA, 21 nt, Artificial Sequence
  Marburg virus siRNA sense strand
cuuaggcuaucuggaaggaac

SEQ ID NO: 34647 - RNA, 21 nt, Artificial Sequence
  Marburg virus siRNA sense strand
uuaggcuaucuggaaggaaca

SEQ ID NO: 34648 - RNA, 21 nt, Artificial Sequence
  Marburg virus siRNA sense strand
uaggcuaucuggaaggaacaa

SEQ ID NO: 34649 - RNA, 21 nt, Artificial Sequence
  Marburg virus siRNA sense strand
aggcuaucuggaaggaacaag

SEQ ID NO: 34650 - RNA, 21 nt, Artificial Sequence
  Marburg virus siRNA sense strand
ggcuaucuggaaggaacaaga

SEQ ID NO: 34651 - RNA, 21 nt, Artificial Sequence
  Marburg virus siRNA sense strand
gcuaucuggaaggaacaagaa

SEQ ID NO: 34652 - RNA, 21 nt, Artificial Sequence
  Marburg virus siRNA sense strand
cuaucuggaaggaacaagaac

SEQ ID NO: 34653 - RNA, 21 nt, Artificial Sequence
  Marburg virus siRNA sense strand
uaucuggaaggaacaagaaca

SEQ ID NO: 34654 - RNA, 21 nt, Artificial Sequence
  Marburg virus siRNA sense strand
aucuggaaggaacaagaacau

SEQ ID NO: 34655 - RNA, 21 nt, Artificial Sequence
  Marburg virus siRNA sense strand
ucuggaaggaacaagaacauu

SEQ ID NO: 34656 - RNA, 21 nt, Artificial Sequence
  Marburg virus siRNA sense strand
cuggaaggaacaagaacauua

SEQ ID NO: 34657 - RNA, 21 nt, Artificial Sequence
  Marburg virus siRNA sense strand
uggaaggaacaagaacauuac

SEQ ID NO: 34658 - RNA, 21 nt, Artificial Sequence
  Marburg virus siRNA sense strand
ggaaggaacaagaacauuacu

SEQ ID NO: 34659 - RNA, 21 nt, Artificial Sequence
  Marburg virus siRNA sense strand
gaaggaacaagaacauuacua

SEQ ID NO: 34660 - RNA, 21 nt, Artificial Sequence
  Marburg virus siRNA sense strand
aaggaacaagaacauuacuag

SEQ ID NO: 34661 - RNA, 21 nt, Artificial Sequence
  Marburg virus siRNA sense strand
aggaacaagaacauuacuagc

SEQ ID NO: 34662 - RNA, 21 nt, Artificial Sequence
  Marburg virus siRNA sense strand
ggaacaagaacauuacuagcu

SEQ ID NO: 34663 - RNA, 21 nt, Artificial Sequence
  Marburg virus siRNA sense strand
gaacaagaacauuacuagcuu

SEQ ID NO: 34664 - RNA, 21 nt, Artificial Sequence
  Marburg virus siRNA sense strand
aacaagaacauuacuagcuuc

SEQ ID NO: 34665 - RNA, 21 nt, Artificial Sequence
  Marburg virus siRNA sense strand
acaagaacauuacuagcuucu

SEQ ID NO: 34666 - RNA, 21 nt, Artificial Sequence
  Marburg virus siRNA sense strand
caagaacauuacuagcuucuc

SEQ ID NO: 34667 - RNA, 21 nt, Artificial Sequence
  Marburg virus siRNA sense strand
aagaacauuacuagcuucucg

SEQ ID NO: 34668 - RNA, 21 nt, Artificial Sequence
  Marburg virus siRNA sense strand
agaacauuacuagcuucucgg

SEQ ID NO: 34669 - RNA, 21 nt, Artificial Sequence
  Marburg virus siRNA sense strand
gaacauuacuagcuucucgga

SEQ ID NO: 34670 - RNA, 21 nt, Artificial Sequence
  Marburg virus siRNA sense strand
aacauuacuagcuucucggac

SEQ ID NO: 34671 - RNA, 21 nt, Artificial Sequence
  Marburg virus siRNA sense strand
acauuacuagcuucucggaca

SEQ ID NO: 34672 - RNA, 21 nt, Artificial Sequence
  Marburg virus siRNA sense strand
cauuacuagcuucucggacaa

SEQ ID NO: 34673 - RNA, 21 nt, Artificial Sequence
  Marburg virus siRNA sense strand
auuacuagcuucucggacaau

SEQ ID NO: 34674 - RNA, 21 nt, Artificial Sequence
  Marburg virus siRNA sense strand
uuacuagcuucucggacaaua

SEQ ID NO: 34675 - RNA, 21 nt, Artificial Sequence
  Marburg virus siRNA sense strand
uacuagcuucucggacaauaa

SEQ ID NO: 34676 - RNA, 21 nt, Artificial Sequence
  Marburg virus siRNA sense strand
acuagcuucucggacaauaag

SEQ ID NO: 34677 - RNA, 21 nt, Artificial Sequence
  Marburg virus siRNA sense strand
cuagcuucucggacaauaagu

SEQ ID NO: 34678 - RNA, 21 nt, Artificial Sequence
  Marburg virus siRNA sense strand
uagcuucucggacaauaaguu

SEQ ID NO: 34679 - RNA, 21 nt, Artificial Sequence
  Marburg virus siRNA sense strand
agcuucucggacaauaaguuu

SEQ ID NO: 34680 - RNA, 21 nt, Artificial Sequence
  Marburg virus siRNA sense strand
gcuucucggacaauaaguuua

SEQ ID NO: 34681 - RNA, 21 nt, Artificial Sequence
  Marburg virus siRNA sense strand
cuucucggacaauaaguuuaa

SEQ ID NO: 34682 - RNA, 21 nt, Artificial Sequence
  Marburg virus siRNA sense strand
uucucggacaauaaguuuaac

SEQ ID NO: 34683 - RNA, 21 nt, Artificial Sequence
  Marburg virus siRNA sense strand
ucucggacaauaaguuuaacu

SEQ ID NO: 34684 - RNA, 21 nt, Artificial Sequence
  Marburg virus siRNA sense strand
cucggacaauaaguuuaacua

SEQ ID NO: 34685 - RNA, 21 nt, Artificial Sequence
  Marburg virus siRNA sense strand
ucggacaauaaguuuaacuac

SEQ ID NO: 34686 - RNA, 21 nt, Artificial Sequence
  Marburg virus siRNA sense strand
cggacaauaaguuuaacuaca

SEQ ID NO: 34687 - RNA, 21 nt, Artificial Sequence
  Marburg virus siRNA sense strand
ggacaauaaguuuaacuacag

SEQ ID NO: 34688 - RNA, 21 nt, Artificial Sequence
  Marburg virus siRNA sense strand
gacaauaaguuuaacuacaga

SEQ ID NO: 34689 - RNA, 21 nt, Artificial Sequence
  Marburg virus siRNA sense strand
acaauaaguuuaacuacagaa

SEQ ID NO: 34690 - RNA, 21 nt, Artificial Sequence
  Marburg virus siRNA sense strand
caauaaguuuaacuacagaag

SEQ ID NO: 34691 - RNA, 21 nt, Artificial Sequence
  Marburg virus siRNA sense strand
aauaaguuuaacuacagaagg

SEQ ID NO: 34692 - RNA, 21 nt, Artificial Sequence
  Marburg virus siRNA sense strand
auaaguuuaacuacagaaggg

SEQ ID NO: 34693 - RNA, 21 nt, Artificial Sequence
  Marburg virus siRNA sense strand
uaaguuuaacuacagaaggga

SEQ ID NO: 34694 - RNA, 21 nt, Artificial Sequence
  Marburg virus siRNA sense strand
aaguuuaacuacagaagggac

SEQ ID NO: 34695 - RNA, 21 nt, Artificial Sequence
  Marburg virus siRNA sense strand
aguuuaacuacagaagggaca

SEQ ID NO: 34696 - RNA, 21 nt, Artificial Sequence
  Marburg virus siRNA sense strand
guuuaacuacagaagggacaa

SEQ ID NO: 34697 - RNA, 21 nt, Artificial Sequence
  Marburg virus siRNA sense strand
uuuaacuacagaagggacaau

SEQ ID NO: 34698 - RNA, 21 nt, Artificial Sequence
  Marburg virus siRNA sense strand
uuaacuacagaagggacaaug

SEQ ID NO: 34699 - RNA, 21 nt, Artificial Sequence
  Marburg virus siRNA sense strand
uaacuacagaagggacaaugu

SEQ ID NO: 34700 - RNA, 21 nt, Artificial Sequence
  Marburg virus siRNA sense strand
aacuacagaagggacaauguu

SEQ ID NO: 34701 - RNA, 21 nt, Artificial Sequence
  Marburg virus siRNA sense strand
acuacagaagggacaauguug

SEQ ID NO: 34702 - RNA, 21 nt, Artificial Sequence
  Marburg virus siRNA sense strand
cuacagaagggacaauguuga

SEQ ID NO: 34703 - RNA, 21 nt, Artificial Sequence
  Marburg virus siRNA sense strand
uacagaagggacaauguugau

SEQ ID NO: 34704 - RNA, 21 nt, Artificial Sequence
  Marburg virus siRNA sense strand
acagaagggacaauguugaug

SEQ ID NO: 34705 - RNA, 21 nt, Artificial Sequence
  Marburg virus siRNA sense strand
cagaagggacaauguugauga

SEQ ID NO: 34706 - RNA, 21 nt, Artificial Sequence
  Marburg virus siRNA sense strand
agaagggacaauguugaugaa

SEQ ID NO: 34707 - RNA, 21 nt, Artificial Sequence
  Marburg virus siRNA sense strand
gaagggacaauguugaugaaa

SEQ ID NO: 34708 - RNA, 21 nt, Artificial Sequence
  Marburg virus siRNA sense strand
aagggacaauguugaugaaau

SEQ ID NO: 34709 - RNA, 21 nt, Artificial Sequence
  Marburg virus siRNA sense strand
agggacaauguugaugaaauu

SEQ ID NO: 34710 - RNA, 21 nt, Artificial Sequence
  Marburg virus siRNA sense strand
gggacaauguugaugaaauua

SEQ ID NO: 34711 - RNA, 21 nt, Artificial Sequence
  Marburg virus siRNA sense strand
ggacaauguugaugaaauuaa

SEQ ID NO: 34712 - RNA, 21 nt, Artificial Sequence
  Marburg virus siRNA sense strand
gacaauguugaugaaauuaag

SEQ ID NO: 34713 - RNA, 21 nt, Artificial Sequence
  Marburg virus siRNA sense strand
acaauguugaugaaauuaagg

SEQ ID NO: 34714 - RNA, 21 nt, Artificial Sequence
  Marburg virus siRNA sense strand
caauguugaugaaauuaaggg

SEQ ID NO: 34715 - RNA, 21 nt, Artificial Sequence
  Marburg virus siRNA sense strand
aauguugaugaaauuaaggga

SEQ ID NO: 34716 - RNA, 21 nt, Artificial Sequence
  Marburg virus siRNA sense strand
auguugaugaaauuaagggaa

SEQ ID NO: 34717 - RNA, 21 nt, Artificial Sequence
  Marburg virus siRNA sense strand
uguugaugaaauuaagggaau

SEQ ID NO: 34718 - RNA, 21 nt, Artificial Sequence
  Marburg virus siRNA sense strand
guugaugaaauuaagggaauu

SEQ ID NO: 34719 - RNA, 21 nt, Artificial Sequence
  Marburg virus siRNA sense strand
uugaugaaauuaagggaauua

SEQ ID NO: 34720 - RNA, 21 nt, Artificial Sequence
  Marburg virus siRNA sense strand
ugaugaaauuaagggaauuaa

SEQ ID NO: 34721 - RNA, 21 nt, Artificial Sequence
  Marburg virus siRNA sense strand
gaugaaauuaagggaauuaac

SEQ ID NO: 34722 - RNA, 21 nt, Artificial Sequence
  Marburg virus siRNA sense strand
augaaauuaagggaauuaaca

SEQ ID NO: 34723 - RNA, 21 nt, Artificial Sequence
  Marburg virus siRNA sense strand
ugaaauuaagggaauuaacaa

SEQ ID NO: 34724 - RNA, 21 nt, Artificial Sequence
  Marburg virus siRNA sense strand
gaaauuaagggaauuaacaag

SEQ ID NO: 34725 - RNA, 21 nt, Artificial Sequence
  Marburg virus siRNA sense strand
aaauuaagggaauuaacaaga

SEQ ID NO: 34726 - RNA, 21 nt, Artificial Sequence
  Marburg virus siRNA sense strand
aauuaagggaauuaacaagaa

SEQ ID NO: 34727 - RNA, 21 nt, Artificial Sequence
  Marburg virus siRNA sense strand
auuaagggaauuaacaagaaa

SEQ ID NO: 34728 - RNA, 21 nt, Artificial Sequence
  Marburg virus siRNA sense strand
uuaagggaauuaacaagaaac

SEQ ID NO: 34729 - RNA, 21 nt, Artificial Sequence
  Marburg virus siRNA sense strand
uaagggaauuaacaagaaacc

SEQ ID NO: 34730 - RNA, 21 nt, Artificial Sequence
  Marburg virus siRNA sense strand
aagggaauuaacaagaaaccg

SEQ ID NO: 34731 - RNA, 21 nt, Artificial Sequence
  Marburg virus siRNA sense strand
agggaauuaacaagaaaccga

SEQ ID NO: 34732 - RNA, 21 nt, Artificial Sequence
  Marburg virus siRNA sense strand
gggaauuaacaagaaaccgau

SEQ ID NO: 34733 - RNA, 21 nt, Artificial Sequence
  Marburg virus siRNA sense strand
ggaauuaacaagaaaccgaug

SEQ ID NO: 34734 - RNA, 21 nt, Artificial Sequence
  Marburg virus siRNA sense strand
gaauuaacaagaaaccgaugg

SEQ ID NO: 34735 - RNA, 21 nt, Artificial Sequence
  Marburg virus siRNA sense strand
aauuaacaagaaaccgaugga

SEQ ID NO: 34736 - RNA, 21 nt, Artificial Sequence
  Marburg virus siRNA sense strand
auuaacaagaaaccgauggaa

SEQ ID NO: 34737 - RNA, 21 nt, Artificial Sequence
  Marburg virus siRNA sense strand
uuaacaagaaaccgauggaaa

SEQ ID NO: 34738 - RNA, 21 nt, Artificial Sequence
  Marburg virus siRNA sense strand
uaacaagaaaccgauggaaaa

SEQ ID NO: 34739 - RNA, 21 nt, Artificial Sequence
  Marburg virus siRNA sense strand
aacaagaaaccgauggaaaag

SEQ ID NO: 34740 - RNA, 21 nt, Artificial Sequence
  Marburg virus siRNA sense strand
acaagaaaccgauggaaaagc

SEQ ID NO: 34741 - RNA, 21 nt, Artificial Sequence
  Marburg virus siRNA sense strand
caagaaaccgauggaaaagcu

SEQ ID NO: 34742 - RNA, 21 nt, Artificial Sequence
  Marburg virus siRNA sense strand
aagaaaccgauggaaaagcug

SEQ ID NO: 34743 - RNA, 21 nt, Artificial Sequence
  Marburg virus siRNA sense strand
agaaaccgauggaaaagcugg

SEQ ID NO: 34744 - RNA, 21 nt, Artificial Sequence
  Marburg virus siRNA sense strand
gaaaccgauggaaaagcuggu

SEQ ID NO: 34745 - RNA, 21 nt, Artificial Sequence
  Marburg virus siRNA sense strand
aaaccgauggaaaagcugguu

SEQ ID NO: 34746 - RNA, 21 nt, Artificial Sequence
  Marburg virus siRNA sense strand
aaccgauggaaaagcugguuu

SEQ ID NO: 34747 - RNA, 21 nt, Artificial Sequence
  Marburg virus siRNA sense strand
accgauggaaaagcugguuuu

SEQ ID NO: 34748 - RNA, 21 nt, Artificial Sequence
  Marburg virus siRNA sense strand
ccgauggaaaagcugguuuuc

SEQ ID NO: 34749 - RNA, 21 nt, Artificial Sequence
  Marburg virus siRNA sense strand
cgauggaaaagcugguuuucu

SEQ ID NO: 34750 - RNA, 21 nt, Artificial Sequence
  Marburg virus siRNA sense strand
gauggaaaagcugguuuucuu

SEQ ID NO: 34751 - RNA, 21 nt, Artificial Sequence
  Marburg virus siRNA sense strand
auggaaaagcugguuuucuua

SEQ ID NO: 34752 - RNA, 21 nt, Artificial Sequence
  Marburg virus siRNA sense strand
uggaaaagcugguuuucuuau

SEQ ID NO: 34753 - RNA, 21 nt, Artificial Sequence
  Marburg virus siRNA sense strand
ggaaaagcugguuuucuuaua

SEQ ID NO: 34754 - RNA, 21 nt, Artificial Sequence
  Marburg virus siRNA sense strand
gaaaagcugguuuucuuauau

SEQ ID NO: 34755 - RNA, 21 nt, Artificial Sequence
  Marburg virus siRNA sense strand
aaaagcugguuuucuuauauu

SEQ ID NO: 34756 - RNA, 21 nt, Artificial Sequence
  Marburg virus siRNA sense strand
aaagcugguuuucuuauauug

SEQ ID NO: 34757 - RNA, 21 nt, Artificial Sequence
  Marburg virus siRNA sense strand
aagcugguuuucuuauauuga

SEQ ID NO: 34758 - RNA, 21 nt, Artificial Sequence
  Marburg virus siRNA sense strand
agcugguuuucuuauauugau

SEQ ID NO: 34759 - RNA, 21 nt, Artificial Sequence
  Marburg virus siRNA sense strand
gcugguuuucuuauauugaug

SEQ ID NO: 34760 - RNA, 21 nt, Artificial Sequence
  Marburg virus siRNA sense strand
cugguuuucuuauauugaugc

SEQ ID NO: 34761 - RNA, 21 nt, Artificial Sequence
  Marburg virus siRNA sense strand
ugguuuucuuauauugaugca

SEQ ID NO: 34762 - RNA, 21 nt, Artificial Sequence
  Marburg virus siRNA sense strand
gguuuucuuauauugaugcau

SEQ ID NO: 34763 - RNA, 21 nt, Artificial Sequence
  Marburg virus siRNA sense strand
guuuucuuauauugaugcauu

SEQ ID NO: 34764 - RNA, 21 nt, Artificial Sequence
  Marburg virus siRNA sense strand
uuuucuuauauugaugcauug

SEQ ID NO: 34765 - RNA, 21 nt, Artificial Sequence
  Marburg virus siRNA sense strand
uuucuuauauugaugcauugg

SEQ ID NO: 34766 - RNA, 21 nt, Artificial Sequence
  Marburg virus siRNA sense strand
uucuuauauugaugcauugga

SEQ ID NO: 34767 - RNA, 21 nt, Artificial Sequence
  Marburg virus siRNA sense strand
ucuuauauugaugcauuggac

SEQ ID NO: 34768 - RNA, 21 nt, Artificial Sequence
  Marburg virus siRNA sense strand
cuuauauugaugcauuggacg

SEQ ID NO: 34769 - RNA, 21 nt, Artificial Sequence
  Marburg virus siRNA sense strand
uuauauugaugcauuggacga

SEQ ID NO: 34770 - RNA, 21 nt, Artificial Sequence
  Marburg virus siRNA sense strand
uauauugaugcauuggacgau

SEQ ID NO: 34771 - RNA, 21 nt, Artificial Sequence
  Marburg virus siRNA sense strand
auauugaugcauuggacgaug

SEQ ID NO: 34772 - RNA, 21 nt, Artificial Sequence
  Marburg virus siRNA sense strand
uauugaugcauuggacgauga

SEQ ID NO: 34773 - RNA, 21 nt, Artificial Sequence
  Marburg virus siRNA sense strand
auugaugcauuggacgaugau

SEQ ID NO: 34774 - RNA, 21 nt, Artificial Sequence
  Marburg virus siRNA sense strand
uugaugcauuggacgaugauu

SEQ ID NO: 34775 - RNA, 21 nt, Artificial Sequence
  Marburg virus siRNA sense strand
ugaugcauuggacgaugauuu

SEQ ID NO: 34776 - RNA, 21 nt, Artificial Sequence
  Marburg virus siRNA sense strand
gaugcauuggacgaugauuua

SEQ ID NO: 34777 - RNA, 21 nt, Artificial Sequence
  Marburg virus siRNA sense strand
augcauuggacgaugauuuau

SEQ ID NO: 34778 - RNA, 21 nt, Artificial Sequence
  Marburg virus siRNA sense strand
ugcauuggacgaugauuuauc

SEQ ID NO: 34779 - RNA, 21 nt, Artificial Sequence
  Marburg virus siRNA sense strand
gcauuggacgaugauuuaucu

SEQ ID NO: 34780 - RNA, 21 nt, Artificial Sequence
  Marburg virus siRNA sense strand
cauuggacgaugauuuaucug

SEQ ID NO: 34781 - RNA, 21 nt, Artificial Sequence
  Marburg virus siRNA sense strand
auuggacgaugauuuaucuga

SEQ ID NO: 34782 - RNA, 21 nt, Artificial Sequence
  Marburg virus siRNA sense strand
uuggacgaugauuuaucugag

SEQ ID NO: 34783 - RNA, 21 nt, Artificial Sequence
  Marburg virus siRNA sense strand
uggacgaugauuuaucugagu

SEQ ID NO: 34784 - RNA, 21 nt, Artificial Sequence
  Marburg virus siRNA sense strand
ggacgaugauuuaucugaguc

SEQ ID NO: 34785 - RNA, 21 nt, Artificial Sequence
  Marburg virus siRNA sense strand
gacgaugauuuaucugagucc

SEQ ID NO: 34786 - RNA, 21 nt, Artificial Sequence
  Marburg virus siRNA sense strand
acgaugauuuaucugaguccu

SEQ ID NO: 34787 - RNA, 21 nt, Artificial Sequence
  Marburg virus siRNA sense strand
cgaugauuuaucugaguccuu

SEQ ID NO: 34788 - RNA, 21 nt, Artificial Sequence
  Marburg virus siRNA sense strand
gaugauuuaucugaguccuua

SEQ ID NO: 34789 - RNA, 21 nt, Artificial Sequence
  Marburg virus siRNA sense strand
augauuuaucugaguccuuag

SEQ ID NO: 34790 - RNA, 21 nt, Artificial Sequence
  Marburg virus siRNA sense strand
ugauuuaucugaguccuuaga

SEQ ID NO: 34791 - RNA, 21 nt, Artificial Sequence
  Marburg virus siRNA sense strand
gauuuaucugaguccuuagaa

SEQ ID NO: 34792 - RNA, 21 nt, Artificial Sequence
  Marburg virus siRNA sense strand
auuuaucugaguccuuagaaa

SEQ ID NO: 34793 - RNA, 21 nt, Artificial Sequence
  Marburg virus siRNA sense strand
uuuaucugaguccuuagaaaa

SEQ ID NO: 34794 - RNA, 21 nt, Artificial Sequence
  Marburg virus siRNA sense strand
uuaucugaguccuuagaaaaa

SEQ ID NO: 34795 - RNA, 21 nt, Artificial Sequence
  Marburg virus siRNA sense strand
uaucugaguccuuagaaaaau

SEQ ID NO: 34796 - RNA, 21 nt, Artificial Sequence
  Marburg virus siRNA sense strand
aucugaguccuuagaaaaauu

SEQ ID NO: 34797 - RNA, 21 nt, Artificial Sequence
  Marburg virus siRNA sense strand
ucugaguccuuagaaaaauuc

SEQ ID NO: 34798 - RNA, 21 nt, Artificial Sequence
  Marburg virus siRNA sense strand
cugaguccuuagaaaaauuca

SEQ ID NO: 34799 - RNA, 21 nt, Artificial Sequence
  Marburg virus siRNA sense strand
ugaguccuuagaaaaauucac

SEQ ID NO: 34800 - RNA, 21 nt, Artificial Sequence
  Marburg virus siRNA sense strand
gaguccuuagaaaaauucaca

SEQ ID NO: 34801 - RNA, 21 nt, Artificial Sequence
  Marburg virus siRNA sense strand
aguccuuagaaaaauucacau

SEQ ID NO: 34802 - RNA, 21 nt, Artificial Sequence
  Marburg virus siRNA sense strand
guccuuagaaaaauucacaug

SEQ ID NO: 34803 - RNA, 21 nt, Artificial Sequence
  Marburg virus siRNA sense strand
uccuuagaaaaauucacaugu

SEQ ID NO: 34804 - RNA, 21 nt, Artificial Sequence
  Marburg virus siRNA sense strand
ccuuagaaaaauucacaugua

SEQ ID NO: 34805 - RNA, 21 nt, Artificial Sequence
  Marburg virus siRNA sense strand
cuuagaaaaauucacauguac

SEQ ID NO: 34806 - RNA, 21 nt, Artificial Sequence
  Marburg virus siRNA sense strand
uuagaaaaauucacauguacu

SEQ ID NO: 34807 - RNA, 21 nt, Artificial Sequence
  Marburg virus siRNA sense strand
uagaaaaauucacauguacug

SEQ ID NO: 34808 - RNA, 21 nt, Artificial Sequence
  Marburg virus siRNA sense strand
agaaaaauucacauguacugu

SEQ ID NO: 34809 - RNA, 21 nt, Artificial Sequence
  Marburg virus siRNA sense strand
gaaaaauucacauguacuguu

SEQ ID NO: 34810 - RNA, 21 nt, Artificial Sequence
  Marburg virus siRNA sense strand
aaaaauucacauguacuguug

SEQ ID NO: 34811 - RNA, 21 nt, Artificial Sequence
  Marburg virus siRNA sense strand
aaaauucacauguacuguuga

SEQ ID NO: 34812 - RNA, 21 nt, Artificial Sequence
  Marburg virus siRNA sense strand
aaauucacauguacuguugau

SEQ ID NO: 34813 - RNA, 21 nt, Artificial Sequence
  Marburg virus siRNA sense strand
aauucacauguacuguugaua

SEQ ID NO: 34814 - RNA, 21 nt, Artificial Sequence
  Marburg virus siRNA sense strand
auucacauguacuguugauau

SEQ ID NO: 34815 - RNA, 21 nt, Artificial Sequence
  Marburg virus siRNA sense strand
uucacauguacuguugauaua

SEQ ID NO: 34816 - RNA, 21 nt, Artificial Sequence
  Marburg virus siRNA sense strand
ucacauguacuguugauauag

SEQ ID NO: 34817 - RNA, 21 nt, Artificial Sequence
  Marburg virus siRNA sense strand
cacauguacuguugauauagc

SEQ ID NO: 34818 - RNA, 21 nt, Artificial Sequence
  Marburg virus siRNA sense strand
acauguacuguugauauagcu

SEQ ID NO: 34819 - RNA, 21 nt, Artificial Sequence
  Marburg virus siRNA sense strand
cauguacuguugauauagcua

SEQ ID NO: 34820 - RNA, 21 nt, Artificial Sequence
  Marburg virus siRNA sense strand
auguacuguugauauagcuaa

SEQ ID NO: 34821 - RNA, 21 nt, Artificial Sequence
  Marburg virus siRNA sense strand
uguacuguugauauagcuaau

SEQ ID NO: 34822 - RNA, 21 nt, Artificial Sequence
  Marburg virus siRNA sense strand
guacuguugauauagcuaauu

SEQ ID NO: 34823 - RNA, 21 nt, Artificial Sequence
  Marburg virus siRNA sense strand
uacuguugauauagcuaauuu

SEQ ID NO: 34824 - RNA, 21 nt, Artificial Sequence
  Marburg virus siRNA sense strand
acuguugauauagcuaauuuc

SEQ ID NO: 34825 - RNA, 21 nt, Artificial Sequence
  Marburg virus siRNA sense strand
cuguugauauagcuaauuucu

SEQ ID NO: 34826 - RNA, 21 nt, Artificial Sequence
  Marburg virus siRNA sense strand
uguugauauagcuaauuucuu

SEQ ID NO: 34827 - RNA, 21 nt, Artificial Sequence
  Marburg virus siRNA sense strand
guugauauagcuaauuucuug

SEQ ID NO: 34828 - RNA, 21 nt, Artificial Sequence
  Marburg virus siRNA sense strand
uugauauagcuaauuucuuga

SEQ ID NO: 34829 - RNA, 21 nt, Artificial Sequence
  Marburg virus siRNA sense strand
ugauauagcuaauuucuugag

SEQ ID NO: 34830 - RNA, 21 nt, Artificial Sequence
  Marburg virus siRNA sense strand
gauauagcuaauuucuugagg

SEQ ID NO: 34831 - RNA, 21 nt, Artificial Sequence
  Marburg virus siRNA sense strand
auauagcuaauuucuugaggg

SEQ ID NO: 34832 - RNA, 21 nt, Artificial Sequence
  Marburg virus siRNA sense strand
uauagcuaauuucuugagggc

SEQ ID NO: 34833 - RNA, 21 nt, Artificial Sequence
  Marburg virus siRNA sense strand
auagcuaauuucuugagggca

SEQ ID NO: 34834 - RNA, 21 nt, Artificial Sequence
  Marburg virus siRNA sense strand
uagcuaauuucuugagggcau

SEQ ID NO: 34835 - RNA, 21 nt, Artificial Sequence
  Marburg virus siRNA sense strand
agcuaauuucuugagggcaua

SEQ ID NO: 34836 - RNA, 21 nt, Artificial Sequence
  Marburg virus siRNA sense strand
gcuaauuucuugagggcauau

SEQ ID NO: 34837 - RNA, 21 nt, Artificial Sequence
  Marburg virus siRNA sense strand
cuaauuucuugagggcauauu

SEQ ID NO: 34838 - RNA, 21 nt, Artificial Sequence
  Marburg virus siRNA sense strand
uaauuucuugagggcauauuc

SEQ ID NO: 34839 - RNA, 21 nt, Artificial Sequence
  Marburg virus siRNA sense strand
aauuucuugagggcauauuca

SEQ ID NO: 34840 - RNA, 21 nt, Artificial Sequence
  Marburg virus siRNA sense strand
auuucuugagggcauauucau

SEQ ID NO: 34841 - RNA, 21 nt, Artificial Sequence
  Marburg virus siRNA sense strand
uuucuugagggcauauucaug

SEQ ID NO: 34842 - RNA, 21 nt, Artificial Sequence
  Marburg virus siRNA sense strand
uucuugagggcauauucaugg

SEQ ID NO: 34843 - RNA, 21 nt, Artificial Sequence
  Marburg virus siRNA sense strand
ucuugagggcauauucauggc

SEQ ID NO: 34844 - RNA, 21 nt, Artificial Sequence
  Marburg virus siRNA sense strand
cuugagggcauauucauggcu

SEQ ID NO: 34845 - RNA, 21 nt, Artificial Sequence
  Marburg virus siRNA sense strand
uugagggcauauucauggcuc

SEQ ID NO: 34846 - RNA, 21 nt, Artificial Sequence
  Marburg virus siRNA sense strand
ugagggcauauucauggcucg

SEQ ID NO: 34847 - RNA, 21 nt, Artificial Sequence
  Marburg virus siRNA sense strand
gagggcauauucauggcucga

SEQ ID NO: 34848 - RNA, 21 nt, Artificial Sequence
  Marburg virus siRNA sense strand
agggcauauucauggcucgac

SEQ ID NO: 34849 - RNA, 21 nt, Artificial Sequence
  Marburg virus siRNA sense strand
gggcauauucauggcucgacg

SEQ ID NO: 34850 - RNA, 21 nt, Artificial Sequence
  Marburg virus siRNA sense strand
ggcauauucauggcucgacgu

SEQ ID NO: 34851 - RNA, 21 nt, Artificial Sequence
  Marburg virus siRNA sense strand
gcauauucauggcucgacguc

SEQ ID NO: 34852 - RNA, 21 nt, Artificial Sequence
  Marburg virus siRNA sense strand
cauauucauggcucgacgucu

SEQ ID NO: 34853 - RNA, 21 nt, Artificial Sequence
  Marburg virus siRNA sense strand
auauucauggcucgacgucuu

SEQ ID NO: 34854 - RNA, 21 nt, Artificial Sequence
  Marburg virus siRNA sense strand
uauucauggcucgacgucuua

SEQ ID NO: 34855 - RNA, 21 nt, Artificial Sequence
  Marburg virus siRNA sense strand
auucauggcucgacgucuuaa

SEQ ID NO: 34856 - RNA, 21 nt, Artificial Sequence
  Marburg virus siRNA sense strand
uucauggcucgacgucuuaaa

SEQ ID NO: 34857 - RNA, 21 nt, Artificial Sequence
  Marburg virus siRNA sense strand
ucauggcucgacgucuuaaaa

SEQ ID NO: 34858 - RNA, 21 nt, Artificial Sequence
  Marburg virus siRNA sense strand
cauggcucgacgucuuaaaag

SEQ ID NO: 34859 - RNA, 21 nt, Artificial Sequence
  Marburg virus siRNA sense strand
auggcucgacgucuuaaaagg

SEQ ID NO: 34860 - RNA, 21 nt, Artificial Sequence
  Marburg virus siRNA sense strand
uggcucgacgucuuaaaaggg

SEQ ID NO: 34861 - RNA, 21 nt, Artificial Sequence
  Marburg virus siRNA sense strand
ggcucgacgucuuaaaaggga

SEQ ID NO: 34862 - RNA, 21 nt, Artificial Sequence
  Marburg virus siRNA sense strand
gcucgacgucuuaaaagggaa

SEQ ID NO: 34863 - RNA, 21 nt, Artificial Sequence
  Marburg virus siRNA sense strand
cucgacgucuuaaaagggaaa

SEQ ID NO: 34864 - RNA, 21 nt, Artificial Sequence
  Marburg virus siRNA sense strand
ucgacgucuuaaaagggaaaa

SEQ ID NO: 34865 - RNA, 21 nt, Artificial Sequence
  Marburg virus siRNA sense strand
cgacgucuuaaaagggaaaag

SEQ ID NO: 34866 - RNA, 21 nt, Artificial Sequence
  Marburg virus siRNA sense strand
gacgucuuaaaagggaaaagg

SEQ ID NO: 34867 - RNA, 21 nt, Artificial Sequence
  Marburg virus siRNA sense strand
acgucuuaaaagggaaaaggc

SEQ ID NO: 34868 - RNA, 21 nt, Artificial Sequence
  Marburg virus siRNA sense strand
cgucuuaaaagggaaaaggcu

SEQ ID NO: 34869 - RNA, 21 nt, Artificial Sequence
  Marburg virus siRNA sense strand
gucuuaaaagggaaaaggcua

SEQ ID NO: 34870 - RNA, 21 nt, Artificial Sequence
  Marburg virus siRNA sense strand
ucuuaaaagggaaaaggcuaa

SEQ ID NO: 34871 - RNA, 21 nt, Artificial Sequence
  Marburg virus siRNA sense strand
cuuaaaagggaaaaggcuaau

SEQ ID NO: 34872 - RNA, 21 nt, Artificial Sequence
  Marburg virus siRNA sense strand
uuaaaagggaaaaggcuaauu

SEQ ID NO: 34873 - RNA, 21 nt, Artificial Sequence
  Marburg virus siRNA sense strand
uaaaagggaaaaggcuaauug

SEQ ID NO: 34874 - RNA, 21 nt, Artificial Sequence
  Marburg virus siRNA sense strand
aaaagggaaaaggcuaauugg

SEQ ID NO: 34875 - RNA, 21 nt, Artificial Sequence
  Marburg virus siRNA sense strand
aaagggaaaaggcuaauuggu

SEQ ID NO: 34876 - RNA, 21 nt, Artificial Sequence
  Marburg virus siRNA sense strand
aagggaaaaggcuaauuggug

SEQ ID NO: 34877 - RNA, 21 nt, Artificial Sequence
  Marburg virus siRNA sense strand
agggaaaaggcuaauuggugc

SEQ ID NO: 34878 - RNA, 21 nt, Artificial Sequence
  Marburg virus siRNA sense strand
gggaaaaggcuaauuggugcc

SEQ ID NO: 34879 - RNA, 21 nt, Artificial Sequence
  Marburg virus siRNA sense strand
ggaaaaggcuaauuggugcca

SEQ ID NO: 34880 - RNA, 21 nt, Artificial Sequence
  Marburg virus siRNA sense strand
gaaaaggcuaauuggugccac

SEQ ID NO: 34881 - RNA, 21 nt, Artificial Sequence
  Marburg virus siRNA sense strand
aaaaggcuaauuggugccaca

SEQ ID NO: 34882 - RNA, 21 nt, Artificial Sequence
  Marburg virus siRNA sense strand
aaaggcuaauuggugccacau

SEQ ID NO: 34883 - RNA, 21 nt, Artificial Sequence
  Marburg virus siRNA sense strand
aaggcuaauuggugccacauu

SEQ ID NO: 34884 - RNA, 21 nt, Artificial Sequence
  Marburg virus siRNA sense strand
aggcuaauuggugccacauug

SEQ ID NO: 34885 - RNA, 21 nt, Artificial Sequence
  Marburg virus siRNA sense strand
ggcuaauuggugccacauugc

SEQ ID NO: 34886 - RNA, 21 nt, Artificial Sequence
  Marburg virus siRNA sense strand
gcuaauuggugccacauugcc

SEQ ID NO: 34887 - RNA, 21 nt, Artificial Sequence
  Marburg virus siRNA sense strand
cuaauuggugccacauugcca

SEQ ID NO: 34888 - RNA, 21 nt, Artificial Sequence
  Marburg virus siRNA sense strand
uaauuggugccacauugccau

SEQ ID NO: 34889 - RNA, 21 nt, Artificial Sequence
  Marburg virus siRNA sense strand
aauuggugccacauugccaug

SEQ ID NO: 34890 - RNA, 21 nt, Artificial Sequence
  Marburg virus siRNA sense strand
auuggugccacauugccaugu

SEQ ID NO: 34891 - RNA, 21 nt, Artificial Sequence
  Marburg virus siRNA sense strand
uuggugccacauugccauguu

SEQ ID NO: 34892 - RNA, 21 nt, Artificial Sequence
  Marburg virus siRNA sense strand
uggugccacauugccauguuu

SEQ ID NO: 34893 - RNA, 21 nt, Artificial Sequence
  Marburg virus siRNA sense strand
ggugccacauugccauguuua

SEQ ID NO: 34894 - RNA, 21 nt, Artificial Sequence
  Marburg virus siRNA sense strand
gugccacauugccauguuuac

SEQ ID NO: 34895 - RNA, 21 nt, Artificial Sequence
  Marburg virus siRNA sense strand
ugccacauugccauguuuacu

SEQ ID NO: 34896 - RNA, 21 nt, Artificial Sequence
  Marburg virus siRNA sense strand
gccacauugccauguuuacua

SEQ ID NO: 34897 - RNA, 21 nt, Artificial Sequence
  Marburg virus siRNA sense strand
ccacauugccauguuuacuag

SEQ ID NO: 34898 - RNA, 21 nt, Artificial Sequence
  Marburg virus siRNA sense strand
cacauugccauguuuacuaga

SEQ ID NO: 34899 - RNA, 21 nt, Artificial Sequence
  Marburg virus siRNA sense strand
acauugccauguuuacuagag

SEQ ID NO: 34900 - RNA, 21 nt, Artificial Sequence
  Marburg virus siRNA sense strand
cauugccauguuuacuagagc

SEQ ID NO: 34901 - RNA, 21 nt, Artificial Sequence
  Marburg virus siRNA sense strand
auugccauguuuacuagagca

SEQ ID NO: 34902 - RNA, 21 nt, Artificial Sequence
  Marburg virus siRNA sense strand
uugccauguuuacuagagcaa

SEQ ID NO: 34903 - RNA, 21 nt, Artificial Sequence
  Marburg virus siRNA sense strand
ugccauguuuacuagagcaau

SEQ ID NO: 34904 - RNA, 21 nt, Artificial Sequence
  Marburg virus siRNA sense strand
gccauguuuacuagagcaauu

SEQ ID NO: 34905 - RNA, 21 nt, Artificial Sequence
  Marburg virus siRNA sense strand
ccauguuuacuagagcaauuu

SEQ ID NO: 34906 - RNA, 21 nt, Artificial Sequence
  Marburg virus siRNA sense strand
cauguuuacuagagcaauuua

SEQ ID NO: 34907 - RNA, 21 nt, Artificial Sequence
  Marburg virus siRNA sense strand
auguuuacuagagcaauuuaa

SEQ ID NO: 34908 - RNA, 21 nt, Artificial Sequence
  Marburg virus siRNA sense strand
uguuuacuagagcaauuuaag

SEQ ID NO: 34909 - RNA, 21 nt, Artificial Sequence
  Marburg virus siRNA sense strand
guuuacuagagcaauuuaagg

SEQ ID NO: 34910 - RNA, 21 nt, Artificial Sequence
  Marburg virus siRNA sense strand
uuuacuagagcaauuuaaggu

SEQ ID NO: 34911 - RNA, 21 nt, Artificial Sequence
  Marburg virus siRNA sense strand
uuacuagagcaauuuaaggua

SEQ ID NO: 34912 - RNA, 21 nt, Artificial Sequence
  Marburg virus siRNA sense strand
uacuagagcaauuuaagguaa

SEQ ID NO: 34913 - RNA, 21 nt, Artificial Sequence
  Marburg virus siRNA sense strand
acuagagcaauuuaagguaaa

SEQ ID NO: 34914 - RNA, 21 nt, Artificial Sequence
  Marburg virus siRNA sense strand
cuagagcaauuuaagguaaag

SEQ ID NO: 34915 - RNA, 21 nt, Artificial Sequence
  Marburg virus siRNA sense strand
uagagcaauuuaagguaaagu

SEQ ID NO: 34916 - RNA, 21 nt, Artificial Sequence
  Marburg virus siRNA sense strand
agagcaauuuaagguaaagug

SEQ ID NO: 34917 - RNA, 21 nt, Artificial Sequence
  Marburg virus siRNA sense strand
gagcaauuuaagguaaagugg

SEQ ID NO: 34918 - RNA, 21 nt, Artificial Sequence
  Marburg virus siRNA sense strand
agcaauuuaagguaaagugga

SEQ ID NO: 34919 - RNA, 21 nt, Artificial Sequence
  Marburg virus siRNA sense strand
gcaauuuaagguaaaguggau

SEQ ID NO: 34920 - RNA, 21 nt, Artificial Sequence
  Marburg virus siRNA sense strand
caauuuaagguaaaguggauu

SEQ ID NO: 34921 - RNA, 21 nt, Artificial Sequence
  Marburg virus siRNA sense strand
aauuuaagguaaaguggauua

SEQ ID NO: 34922 - RNA, 21 nt, Artificial Sequence
  Marburg virus siRNA sense strand
auuuaagguaaaguggauuaa

SEQ ID NO: 34923 - RNA, 21 nt, Artificial Sequence
  Marburg virus siRNA sense strand
uuuaagguaaaguggauuaau

SEQ ID NO: 34924 - RNA, 21 nt, Artificial Sequence
  Marburg virus siRNA sense strand
uuaagguaaaguggauuaauu

SEQ ID NO: 34925 - RNA, 21 nt, Artificial Sequence
  Marburg virus siRNA sense strand
uaagguaaaguggauuaauuu

SEQ ID NO: 34926 - RNA, 21 nt, Artificial Sequence
  Marburg virus siRNA sense strand
aagguaaaguggauuaauuug

SEQ ID NO: 34927 - RNA, 21 nt, Artificial Sequence
  Marburg virus siRNA sense strand
agguaaaguggauuaauuugu

SEQ ID NO: 34928 - RNA, 21 nt, Artificial Sequence
  Marburg virus siRNA sense strand
gguaaaguggauuaauuuguc

SEQ ID NO: 34929 - RNA, 21 nt, Artificial Sequence
  Marburg virus siRNA sense strand
guaaaguggauuaauuugucu

SEQ ID NO: 34930 - RNA, 21 nt, Artificial Sequence
  Marburg virus siRNA sense strand
uaaaguggauuaauuugucug

SEQ ID NO: 34931 - RNA, 21 nt, Artificial Sequence
  Marburg virus siRNA sense strand
aaaguggauuaauuugucuga

SEQ ID NO: 34932 - RNA, 21 nt, Artificial Sequence
  Marburg virus siRNA sense strand
aaguggauuaauuugucugag

SEQ ID NO: 34933 - RNA, 21 nt, Artificial Sequence
  Marburg virus siRNA sense strand
aguggauuaauuugucugagg

SEQ ID NO: 34934 - RNA, 21 nt, Artificial Sequence
  Marburg virus siRNA sense strand
guggauuaauuugucugagga

SEQ ID NO: 34935 - RNA, 21 nt, Artificial Sequence
  Marburg virus siRNA sense strand
uggauuaauuugucugaggau

SEQ ID NO: 34936 - RNA, 21 nt, Artificial Sequence
  Marburg virus siRNA sense strand
ggauuaauuugucugaggauu

SEQ ID NO: 34937 - RNA, 21 nt, Artificial Sequence
  Marburg virus siRNA sense strand
gauuaauuugucugaggauuu

SEQ ID NO: 34938 - RNA, 21 nt, Artificial Sequence
  Marburg virus siRNA sense strand
auuaauuugucugaggauuua

SEQ ID NO: 34939 - RNA, 21 nt, Artificial Sequence
  Marburg virus siRNA sense strand
uuaauuugucugaggauuuaa

SEQ ID NO: 34940 - RNA, 21 nt, Artificial Sequence
  Marburg virus siRNA sense strand
uaauuugucugaggauuuaag

SEQ ID NO: 34941 - RNA, 21 nt, Artificial Sequence
  Marburg virus siRNA sense strand
aauuugucugaggauuuaagg

SEQ ID NO: 34942 - RNA, 21 nt, Artificial Sequence
  Marburg virus siRNA sense strand
auuugucugaggauuuaaggg

SEQ ID NO: 34943 - RNA, 21 nt, Artificial Sequence
  Marburg virus siRNA sense strand
uuugucugaggauuuaaggga

SEQ ID NO: 34944 - RNA, 21 nt, Artificial Sequence
  Marburg virus siRNA sense strand
uugucugaggauuuaagggaa

SEQ ID NO: 34945 - RNA, 21 nt, Artificial Sequence
  Marburg virus siRNA sense strand
ugucugaggauuuaagggaac

SEQ ID NO: 34946 - RNA, 21 nt, Artificial Sequence
  Marburg virus siRNA sense strand
gucugaggauuuaagggaaca

SEQ ID NO: 34947 - RNA, 21 nt, Artificial Sequence
  Marburg virus siRNA sense strand
ucugaggauuuaagggaacaa

SEQ ID NO: 34948 - RNA, 21 nt, Artificial Sequence
  Marburg virus siRNA sense strand
cugaggauuuaagggaacaau

SEQ ID NO: 34949 - RNA, 21 nt, Artificial Sequence
  Marburg virus siRNA sense strand
ugaggauuuaagggaacaauu

SEQ ID NO: 34950 - RNA, 21 nt, Artificial Sequence
  Marburg virus siRNA sense strand
gaggauuuaagggaacaauuu

SEQ ID NO: 34951 - RNA, 21 nt, Artificial Sequence
  Marburg virus siRNA sense strand
aggauuuaagggaacaauuua

SEQ ID NO: 34952 - RNA, 21 nt, Artificial Sequence
  Marburg virus siRNA sense strand
ggauuuaagggaacaauuuaa

SEQ ID NO: 34953 - RNA, 21 nt, Artificial Sequence
  Marburg virus siRNA sense strand
gauuuaagggaacaauuuaau

SEQ ID NO: 34954 - RNA, 21 nt, Artificial Sequence
  Marburg virus siRNA sense strand
auuuaagggaacaauuuaaua

SEQ ID NO: 34955 - RNA, 21 nt, Artificial Sequence
  Marburg virus siRNA sense strand
uuuaagggaacaauuuaauau

SEQ ID NO: 34956 - RNA, 21 nt, Artificial Sequence
  Marburg virus siRNA sense strand
uuaagggaacaauuuaauaug

SEQ ID NO: 34957 - RNA, 21 nt, Artificial Sequence
  Marburg virus siRNA sense strand
uaagggaacaauuuaauaugu

SEQ ID NO: 34958 - RNA, 21 nt, Artificial Sequence
  Marburg virus siRNA sense strand
aagggaacaauuuaauauguc

SEQ ID NO: 34959 - RNA, 21 nt, Artificial Sequence
  Marburg virus siRNA sense strand
agggaacaauuuaauaugucu

SEQ ID NO: 34960 - RNA, 21 nt, Artificial Sequence
  Marburg virus siRNA sense strand
gggaacaauuuaauaugucuu

SEQ ID NO: 34961 - RNA, 21 nt, Artificial Sequence
  Marburg virus siRNA sense strand
ggaacaauuuaauaugucuuc

SEQ ID NO: 34962 - RNA, 21 nt, Artificial Sequence
  Marburg virus siRNA sense strand
gaacaauuuaauaugucuuca

SEQ ID NO: 34963 - RNA, 21 nt, Artificial Sequence
  Marburg virus siRNA sense strand
aacaauuuaauaugucuucag

SEQ ID NO: 34964 - RNA, 21 nt, Artificial Sequence
  Marburg virus siRNA sense strand
acaauuuaauaugucuucaga

SEQ ID NO: 34965 - RNA, 21 nt, Artificial Sequence
  Marburg virus siRNA sense strand
caauuuaauaugucuucagaa

SEQ ID NO: 34966 - RNA, 21 nt, Artificial Sequence
  Marburg virus siRNA sense strand
aauuuaauaugucuucagaau

SEQ ID NO: 34967 - RNA, 21 nt, Artificial Sequence
  Marburg virus siRNA sense strand
auuuaauaugucuucagaauc

SEQ ID NO: 34968 - RNA, 21 nt, Artificial Sequence
  Marburg virus siRNA sense strand
uuuaauaugucuucagaauca

SEQ ID NO: 34969 - RNA, 21 nt, Artificial Sequence
  Marburg virus siRNA sense strand
uuaauaugucuucagaaucag

SEQ ID NO: 34970 - RNA, 21 nt, Artificial Sequence
  Marburg virus siRNA sense strand
uaauaugucuucagaaucaga

SEQ ID NO: 34971 - RNA, 21 nt, Artificial Sequence
  Marburg virus siRNA sense strand
aauaugucuucagaaucagaa

SEQ ID NO: 34972 - RNA, 21 nt, Artificial Sequence
  Marburg virus siRNA sense strand
auaugucuucagaaucagaau

SEQ ID NO: 34973 - RNA, 21 nt, Artificial Sequence
  Marburg virus siRNA sense strand
uaugucuucagaaucagaauc

SEQ ID NO: 34974 - RNA, 21 nt, Artificial Sequence
  Marburg virus siRNA sense strand
augucuucagaaucagaauca

SEQ ID NO: 34975 - RNA, 21 nt, Artificial Sequence
  Marburg virus siRNA sense strand
ugucuucagaaucagaaucaa

SEQ ID NO: 34976 - RNA, 21 nt, Artificial Sequence
  Marburg virus siRNA sense strand
gucuucagaaucagaaucaac

SEQ ID NO: 34977 - RNA, 21 nt, Artificial Sequence
  Marburg virus siRNA sense strand
ucuucagaaucagaaucaacu

SEQ ID NO: 34978 - RNA, 21 nt, Artificial Sequence
  Marburg virus siRNA sense strand
cuucagaaucagaaucaacua

SEQ ID NO: 34979 - RNA, 21 nt, Artificial Sequence
  Marburg virus siRNA sense strand
uucagaaucagaaucaacuau

SEQ ID NO: 34980 - RNA, 21 nt, Artificial Sequence
  Marburg virus siRNA sense strand
ucagaaucagaaucaacuaua

SEQ ID NO: 34981 - RNA, 21 nt, Artificial Sequence
  Marburg virus siRNA sense strand
cagaaucagaaucaacuauaa

SEQ ID NO: 34982 - RNA, 21 nt, Artificial Sequence
  Marburg virus siRNA sense strand
agaaucagaaucaacuauaaa

SEQ ID NO: 34983 - RNA, 21 nt, Artificial Sequence
  Marburg virus siRNA sense strand
gaaucagaaucaacuauaaau

SEQ ID NO: 34984 - RNA, 21 nt, Artificial Sequence
  Marburg virus siRNA sense strand
aaucagaaucaacuauaaauu

SEQ ID NO: 34985 - RNA, 21 nt, Artificial Sequence
  Marburg virus siRNA sense strand
aucagaaucaacuauaaauuu

SEQ ID NO: 34986 - RNA, 21 nt, Artificial Sequence
  Marburg virus siRNA sense strand
ucagaaucaacuauaaauuua

SEQ ID NO: 34987 - RNA, 21 nt, Artificial Sequence
  Marburg virus siRNA sense strand
cagaaucaacuauaaauuuau

SEQ ID NO: 34988 - RNA, 21 nt, Artificial Sequence
  Marburg virus siRNA sense strand
agaaucaacuauaaauuuauu

SEQ ID NO: 34989 - RNA, 21 nt, Artificial Sequence
  Marburg virus siRNA sense strand
gaaucaacuauaaauuuauug

SEQ ID NO: 34990 - RNA, 21 nt, Artificial Sequence
  Marburg virus siRNA sense strand
aaucaacuauaaauuuauugc

SEQ ID NO: 34991 - RNA, 21 nt, Artificial Sequence
  Marburg virus siRNA sense strand
aucaacuauaaauuuauugcc

SEQ ID NO: 34992 - RNA, 21 nt, Artificial Sequence
  Marburg virus siRNA sense strand
ucaacuauaaauuuauugccg

SEQ ID NO: 34993 - RNA, 21 nt, Artificial Sequence
  Marburg virus siRNA sense strand
caacuauaaauuuauugccgu

SEQ ID NO: 34994 - RNA, 21 nt, Artificial Sequence
  Marburg virus siRNA sense strand
aacuauaaauuuauugccgua

SEQ ID NO: 34995 - RNA, 21 nt, Artificial Sequence
  Marburg virus siRNA sense strand
acuauaaauuuauugccguau

SEQ ID NO: 34996 - RNA, 21 nt, Artificial Sequence
  Marburg virus siRNA sense strand
cuauaaauuuauugccguaug

SEQ ID NO: 34997 - RNA, 21 nt, Artificial Sequence
  Marburg virus siRNA sense strand
uauaaauuuauugccguauga

SEQ ID NO: 34998 - RNA, 21 nt, Artificial Sequence
  Marburg virus siRNA sense strand
auaaauuuauugccguaugac

SEQ ID NO: 34999 - RNA, 21 nt, Artificial Sequence
  Marburg virus siRNA sense strand
uaaauuuauugccguaugacu

SEQ ID NO: 35000 - RNA, 21 nt, Artificial Sequence
  Marburg virus siRNA sense strand
aaauuuauugccguaugacug

SEQ ID NO: 35001 - RNA, 21 nt, Artificial Sequence
  Marburg virus siRNA sense strand
aauuuauugccguaugacugc

SEQ ID NO: 35002 - RNA, 21 nt, Artificial Sequence
  Marburg virus siRNA sense strand
auuuauugccguaugacugca

SEQ ID NO: 35003 - RNA, 21 nt, Artificial Sequence
  Marburg virus siRNA sense strand
uuuauugccguaugacugcaa

SEQ ID NO: 35004 - RNA, 21 nt, Artificial Sequence
  Marburg virus siRNA sense strand
uuauugccguaugacugcaag

SEQ ID NO: 35005 - RNA, 21 nt, Artificial Sequence
  Marburg virus siRNA sense strand
uauugccguaugacugcaagg

SEQ ID NO: 35006 - RNA, 21 nt, Artificial Sequence
  Marburg virus siRNA sense strand
auugccguaugacugcaagga

SEQ ID NO: 35007 - RNA, 21 nt, Artificial Sequence
  Marburg virus siRNA sense strand
uugccguaugacugcaaggaa

SEQ ID NO: 35008 - RNA, 21 nt, Artificial Sequence
  Marburg virus siRNA sense strand
ugccguaugacugcaaggaac

SEQ ID NO: 35009 - RNA, 21 nt, Artificial Sequence
  Marburg virus siRNA sense strand
gccguaugacugcaaggaacu

SEQ ID NO: 35010 - RNA, 21 nt, Artificial Sequence
  Marburg virus siRNA sense strand
ccguaugacugcaaggaacug

SEQ ID NO: 35011 - RNA, 21 nt, Artificial Sequence
  Marburg virus siRNA sense strand
cguaugacugcaaggaacugc

SEQ ID NO: 35012 - RNA, 21 nt, Artificial Sequence
  Marburg virus siRNA sense strand
guaugacugcaaggaacugcg

SEQ ID NO: 35013 - RNA, 21 nt, Artificial Sequence
  Marburg virus siRNA sense strand
uaugacugcaaggaacugcga

SEQ ID NO: 35014 - RNA, 21 nt, Artificial Sequence
  Marburg virus siRNA sense strand
augacugcaaggaacugcgac

SEQ ID NO: 35015 - RNA, 21 nt, Artificial Sequence
  Marburg virus siRNA sense strand
ugacugcaaggaacugcgacu

SEQ ID NO: 35016 - RNA, 21 nt, Artificial Sequence
  Marburg virus siRNA sense strand
gacugcaaggaacugcgacuu

SEQ ID NO: 35017 - RNA, 21 nt, Artificial Sequence
  Marburg virus siRNA sense strand
acugcaaggaacugcgacuug

SEQ ID NO: 35018 - RNA, 21 nt, Artificial Sequence
  Marburg virus siRNA sense strand
cugcaaggaacugcgacuugg

SEQ ID NO: 35019 - RNA, 21 nt, Artificial Sequence
  Marburg virus siRNA sense strand
ugcaaggaacugcgacuugga

SEQ ID NO: 35020 - RNA, 21 nt, Artificial Sequence
  Marburg virus siRNA sense strand
gcaaggaacugcgacuuggaa

SEQ ID NO: 35021 - RNA, 21 nt, Artificial Sequence
  Marburg virus siRNA sense strand
caaggaacugcgacuuggaag

SEQ ID NO: 35022 - RNA, 21 nt, Artificial Sequence
  Marburg virus siRNA sense strand
aaggaacugcgacuuggaaga

SEQ ID NO: 35023 - RNA, 21 nt, Artificial Sequence
  Marburg virus siRNA sense strand
aggaacugcgacuuggaagaa

SEQ ID NO: 35024 - RNA, 21 nt, Artificial Sequence
  Marburg virus siRNA sense strand
ggaacugcgacuuggaagaag

SEQ ID NO: 35025 - RNA, 21 nt, Artificial Sequence
  Marburg virus siRNA sense strand
gaacugcgacuuggaagaagc

SEQ ID NO: 35026 - RNA, 21 nt, Artificial Sequence
  Marburg virus siRNA sense strand
aacugcgacuuggaagaagca

SEQ ID NO: 35027 - RNA, 21 nt, Artificial Sequence
  Marburg virus siRNA sense strand
acugcgacuuggaagaagcaa

SEQ ID NO: 35028 - RNA, 21 nt, Artificial Sequence
  Marburg virus siRNA sense strand
cugcgacuuggaagaagcaau

SEQ ID NO: 35029 - RNA, 21 nt, Artificial Sequence
  Marburg virus siRNA sense strand
ugcgacuuggaagaagcaaug

SEQ ID NO: 35030 - RNA, 21 nt, Artificial Sequence
  Marburg virus siRNA sense strand
gcgacuuggaagaagcaauga

SEQ ID NO: 35031 - RNA, 21 nt, Artificial Sequence
  Marburg virus siRNA sense strand
cgacuuggaagaagcaaugac

SEQ ID NO: 35032 - RNA, 21 nt, Artificial Sequence
  Marburg virus siRNA sense strand
gacuuggaagaagcaaugaca

SEQ ID NO: 35033 - RNA, 21 nt, Artificial Sequence
  Marburg virus siRNA sense strand
acuuggaagaagcaaugacac

SEQ ID NO: 35034 - RNA, 21 nt, Artificial Sequence
  Marburg virus siRNA sense strand
cuuggaagaagcaaugacaca

SEQ ID NO: 35035 - RNA, 21 nt, Artificial Sequence
  Marburg virus siRNA sense strand
uuggaagaagcaaugacacag

SEQ ID NO: 35036 - RNA, 21 nt, Artificial Sequence
  Marburg virus siRNA sense strand
uggaagaagcaaugacacaga

SEQ ID NO: 35037 - RNA, 21 nt, Artificial Sequence
  Marburg virus siRNA sense strand
ggaagaagcaaugacacagag

SEQ ID NO: 35038 - RNA, 21 nt, Artificial Sequence
  Marburg virus siRNA sense strand
gaagaagcaaugacacagagu

SEQ ID NO: 35039 - RNA, 21 nt, Artificial Sequence
  Marburg virus siRNA sense strand
aagaagcaaugacacagaguu

SEQ ID NO: 35040 - RNA, 21 nt, Artificial Sequence
  Marburg virus siRNA sense strand
agaagcaaugacacagaguua

SEQ ID NO: 35041 - RNA, 21 nt, Artificial Sequence
  Marburg virus siRNA sense strand
gaagcaaugacacagaguuaa

SEQ ID NO: 35042 - RNA, 21 nt, Artificial Sequence
  Marburg virus siRNA sense strand
aagcaaugacacagaguuaaa

SEQ ID NO: 35043 - RNA, 21 nt, Artificial Sequence
  Marburg virus siRNA sense strand
agcaaugacacagaguuaaac

SEQ ID NO: 35044 - RNA, 21 nt, Artificial Sequence
  Marburg virus siRNA sense strand
gcaaugacacagaguuaaacu

SEQ ID NO: 35045 - RNA, 21 nt, Artificial Sequence
  Marburg virus siRNA sense strand
caaugacacagaguuaaacua

SEQ ID NO: 35046 - RNA, 21 nt, Artificial Sequence
  Marburg virus siRNA sense strand
aaugacacagaguuaaacuau

SEQ ID NO: 35047 - RNA, 21 nt, Artificial Sequence
  Marburg virus siRNA sense strand
augacacagaguuaaacuaug

SEQ ID NO: 35048 - RNA, 21 nt, Artificial Sequence
  Marburg virus siRNA sense strand
ugacacagaguuaaacuaugu

SEQ ID NO: 35049 - RNA, 21 nt, Artificial Sequence
  Marburg virus siRNA sense strand
gacacagaguuaaacuauguc

SEQ ID NO: 35050 - RNA, 21 nt, Artificial Sequence
  Marburg virus siRNA sense strand
acacagaguuaaacuauguca

SEQ ID NO: 35051 - RNA, 21 nt, Artificial Sequence
  Marburg virus siRNA sense strand
cacagaguuaaacuaugucag

SEQ ID NO: 35052 - RNA, 21 nt, Artificial Sequence
  Marburg virus siRNA sense strand
acagaguuaaacuaugucagu

SEQ ID NO: 35053 - RNA, 21 nt, Artificial Sequence
  Marburg virus siRNA sense strand
cagaguuaaacuaugucaguu

SEQ ID NO: 35054 - RNA, 21 nt, Artificial Sequence
  Marburg virus siRNA sense strand
agaguuaaacuaugucaguug

SEQ ID NO: 35055 - RNA, 21 nt, Artificial Sequence
  Marburg virus siRNA sense strand
gaguuaaacuaugucaguugu

SEQ ID NO: 35056 - RNA, 21 nt, Artificial Sequence
  Marburg virus siRNA sense strand
aguuaaacuaugucaguugug

SEQ ID NO: 35057 - RNA, 21 nt, Artificial Sequence
  Marburg virus siRNA sense strand
guuaaacuaugucaguugugc

SEQ ID NO: 35058 - RNA, 21 nt, Artificial Sequence
  Marburg virus siRNA sense strand
uuaaacuaugucaguugugcu

SEQ ID NO: 35059 - RNA, 21 nt, Artificial Sequence
  Marburg virus siRNA sense strand
uaaacuaugucaguugugcuc

SEQ ID NO: 35060 - RNA, 21 nt, Artificial Sequence
  Marburg virus siRNA sense strand
aaacuaugucaguugugcucu

SEQ ID NO: 35061 - RNA, 21 nt, Artificial Sequence
  Marburg virus siRNA sense strand
aacuaugucaguugugcucuc

SEQ ID NO: 35062 - RNA, 21 nt, Artificial Sequence
  Marburg virus siRNA sense strand
acuaugucaguugugcucucg

SEQ ID NO: 35063 - RNA, 21 nt, Artificial Sequence
  Marburg virus siRNA sense strand
cuaugucaguugugcucucga

SEQ ID NO: 35064 - RNA, 21 nt, Artificial Sequence
  Marburg virus siRNA sense strand
uaugucaguugugcucucgac

SEQ ID NO: 35065 - RNA, 21 nt, Artificial Sequence
  Marburg virus siRNA sense strand
augucaguugugcucucgacc

SEQ ID NO: 35066 - RNA, 21 nt, Artificial Sequence
  Marburg virus siRNA sense strand
ugucaguugugcucucgaccg

SEQ ID NO: 35067 - RNA, 21 nt, Artificial Sequence
  Marburg virus siRNA sense strand
gucaguugugcucucgaccgg

SEQ ID NO: 35068 - RNA, 21 nt, Artificial Sequence
  Marburg virus siRNA sense strand
ucaguugugcucucgaccgga

SEQ ID NO: 35069 - RNA, 21 nt, Artificial Sequence
  Marburg virus siRNA sense strand
caguugugcucucgaccggaa

SEQ ID NO: 35070 - RNA, 21 nt, Artificial Sequence
  Marburg virus siRNA sense strand
aguugugcucucgaccggaaa

SEQ ID NO: 35071 - RNA, 21 nt, Artificial Sequence
  Marburg virus siRNA sense strand
guugugcucucgaccggaaag

SEQ ID NO: 35072 - RNA, 21 nt, Artificial Sequence
  Marburg virus siRNA sense strand
uugugcucucgaccggaaagu

SEQ ID NO: 35073 - RNA, 21 nt, Artificial Sequence
  Marburg virus siRNA sense strand
ugugcucucgaccggaaaguu

SEQ ID NO: 35074 - RNA, 21 nt, Artificial Sequence
  Marburg virus siRNA sense strand
gugcucucgaccggaaaguug

SEQ ID NO: 35075 - RNA, 21 nt, Artificial Sequence
  Marburg virus siRNA sense strand
ugcucucgaccggaaaguugu

SEQ ID NO: 35076 - RNA, 21 nt, Artificial Sequence
  Marburg virus siRNA sense strand
gcucucgaccggaaaguuguc

SEQ ID NO: 35077 - RNA, 21 nt, Artificial Sequence
  Marburg virus siRNA sense strand
cucucgaccggaaaguugucc

SEQ ID NO: 35078 - RNA, 21 nt, Artificial Sequence
  Marburg virus siRNA sense strand
ucucgaccggaaaguugucca

SEQ ID NO: 35079 - RNA, 21 nt, Artificial Sequence
  Marburg virus siRNA sense strand
cucgaccggaaaguuguccag

SEQ ID NO: 35080 - RNA, 21 nt, Artificial Sequence
  Marburg virus siRNA sense strand
ucgaccggaaaguuguccaga

SEQ ID NO: 35081 - RNA, 21 nt, Artificial Sequence
  Marburg virus siRNA sense strand
cgaccggaaaguuguccagaa

SEQ ID NO: 35082 - RNA, 21 nt, Artificial Sequence
  Marburg virus siRNA sense strand
gaccggaaaguuguccagaaa

SEQ ID NO: 35083 - RNA, 21 nt, Artificial Sequence
  Marburg virus siRNA sense strand
accggaaaguuguccagaaac

SEQ ID NO: 35084 - RNA, 21 nt, Artificial Sequence
  Marburg virus siRNA sense strand
ccggaaaguuguccagaaaca

SEQ ID NO: 35085 - RNA, 21 nt, Artificial Sequence
  Marburg virus siRNA sense strand
cggaaaguuguccagaaacau

SEQ ID NO: 35086 - RNA, 21 nt, Artificial Sequence
  Marburg virus siRNA sense strand
ggaaaguuguccagaaacauc

SEQ ID NO: 35087 - RNA, 21 nt, Artificial Sequence
  Marburg virus siRNA sense strand
gaaaguuguccagaaacaucc

SEQ ID NO: 35088 - RNA, 21 nt, Artificial Sequence
  Marburg virus siRNA sense strand
aaaguuguccagaaacauccc

SEQ ID NO: 35089 - RNA, 21 nt, Artificial Sequence
  Marburg virus siRNA sense strand
aaguuguccagaaacaucccu

SEQ ID NO: 35090 - RNA, 21 nt, Artificial Sequence
  Marburg virus siRNA sense strand
aguuguccagaaacaucccuc

SEQ ID NO: 35091 - RNA, 21 nt, Artificial Sequence
  Marburg virus siRNA sense strand
guuguccagaaacaucccucu

SEQ ID NO: 35092 - RNA, 21 nt, Artificial Sequence
  Marburg virus siRNA sense strand
uuguccagaaacaucccucug

SEQ ID NO: 35093 - RNA, 21 nt, Artificial Sequence
  Marburg virus siRNA sense strand
uguccagaaacaucccucugu

SEQ ID NO: 35094 - RNA, 21 nt, Artificial Sequence
  Marburg virus siRNA sense strand
guccagaaacaucccucuguu

SEQ ID NO: 35095 - RNA, 21 nt, Artificial Sequence
  Marburg virus siRNA sense strand
uccagaaacaucccucuguua

SEQ ID NO: 35096 - RNA, 21 nt, Artificial Sequence
  Marburg virus siRNA sense strand
ccagaaacaucccucuguuaa

SEQ ID NO: 35097 - RNA, 21 nt, Artificial Sequence
  Marburg virus siRNA sense strand
cagaaacaucccucuguuaau

SEQ ID NO: 35098 - RNA, 21 nt, Artificial Sequence
  Marburg virus siRNA sense strand
agaaacaucccucuguuaauc

SEQ ID NO: 35099 - RNA, 21 nt, Artificial Sequence
  Marburg virus siRNA sense strand
gaaacaucccucuguuaaucg

SEQ ID NO: 35100 - RNA, 21 nt, Artificial Sequence
  Marburg virus siRNA sense strand
aaacaucccucuguuaaucgu

SEQ ID NO: 35101 - RNA, 21 nt, Artificial Sequence
  Marburg virus siRNA sense strand
aacaucccucuguuaaucguc

SEQ ID NO: 35102 - RNA, 21 nt, Artificial Sequence
  Marburg virus siRNA sense strand
acaucccucuguuaaucgucu

SEQ ID NO: 35103 - RNA, 21 nt, Artificial Sequence
  Marburg virus siRNA sense strand
caucccucuguuaaucgucug

SEQ ID NO: 35104 - RNA, 21 nt, Artificial Sequence
  Marburg virus siRNA sense strand
aucccucuguuaaucgucugg

SEQ ID NO: 35105 - RNA, 21 nt, Artificial Sequence
  Marburg virus siRNA sense strand
ucccucuguuaaucgucuggc

SEQ ID NO: 35106 - RNA, 21 nt, Artificial Sequence
  Marburg virus siRNA sense strand
cccucuguuaaucgucuggcu

SEQ ID NO: 35107 - RNA, 21 nt, Artificial Sequence
  Marburg virus siRNA sense strand
ccucuguuaaucgucuggcuu

SEQ ID NO: 35108 - RNA, 21 nt, Artificial Sequence
  Marburg virus siRNA sense strand
cucuguuaaucgucuggcuug

SEQ ID NO: 35109 - RNA, 21 nt, Artificial Sequence
  Marburg virus siRNA sense strand
ucuguuaaucgucuggcuugg

SEQ ID NO: 35110 - RNA, 21 nt, Artificial Sequence
  Marburg virus siRNA sense strand
cuguuaaucgucuggcuugga

SEQ ID NO: 35111 - RNA, 21 nt, Artificial Sequence
  Marburg virus siRNA sense strand
uguuaaucgucuggcuuggac

SEQ ID NO: 35112 - RNA, 21 nt, Artificial Sequence
  Marburg virus siRNA sense strand
guuaaucgucuggcuuggaca

SEQ ID NO: 35113 - RNA, 21 nt, Artificial Sequence
  Marburg virus siRNA sense strand
uuaaucgucuggcuuggacaa

SEQ ID NO: 35114 - RNA, 21 nt, Artificial Sequence
  Marburg virus siRNA sense strand
uaaucgucuggcuuggacaau

SEQ ID NO: 35115 - RNA, 21 nt, Artificial Sequence
  Marburg virus siRNA sense strand
aaucgucuggcuuggacaaua

SEQ ID NO: 35116 - RNA, 21 nt, Artificial Sequence
  Marburg virus siRNA sense strand
aucgucuggcuuggacaauag

SEQ ID NO: 35117 - RNA, 21 nt, Artificial Sequence
  Marburg virus siRNA sense strand
ucgucuggcuuggacaauagg

SEQ ID NO: 35118 - RNA, 21 nt, Artificial Sequence
  Marburg virus siRNA sense strand
cgucuggcuuggacaauagga

SEQ ID NO: 35119 - RNA, 21 nt, Artificial Sequence
  Marburg virus siRNA sense strand
gucuggcuuggacaauaggaa

SEQ ID NO: 35120 - RNA, 21 nt, Artificial Sequence
  Marburg virus siRNA sense strand
ucuggcuuggacaauaggaaa

SEQ ID NO: 35121 - RNA, 21 nt, Artificial Sequence
  Marburg virus siRNA sense strand
cuggcuuggacaauaggaaau

SEQ ID NO: 35122 - RNA, 21 nt, Artificial Sequence
  Marburg virus siRNA sense strand
uggcuuggacaauaggaaauc

SEQ ID NO: 35123 - RNA, 21 nt, Artificial Sequence
  Marburg virus siRNA sense strand
ggcuuggacaauaggaaaucg

SEQ ID NO: 35124 - RNA, 21 nt, Artificial Sequence
  Marburg virus siRNA sense strand
gcuuggacaauaggaaaucga

SEQ ID NO: 35125 - RNA, 21 nt, Artificial Sequence
  Marburg virus siRNA sense strand
cuuggacaauaggaaaucgag

SEQ ID NO: 35126 - RNA, 21 nt, Artificial Sequence
  Marburg virus siRNA sense strand
uuggacaauaggaaaucgagc

SEQ ID NO: 35127 - RNA, 21 nt, Artificial Sequence
  Marburg virus siRNA sense strand
uggacaauaggaaaucgagca

SEQ ID NO: 35128 - RNA, 21 nt, Artificial Sequence
  Marburg virus siRNA sense strand
ggacaauaggaaaucgagcac

SEQ ID NO: 35129 - RNA, 21 nt, Artificial Sequence
  Marburg virus siRNA sense strand
gacaauaggaaaucgagcacc

SEQ ID NO: 35130 - RNA, 21 nt, Artificial Sequence
  Marburg virus siRNA sense strand
acaauaggaaaucgagcaccg

SEQ ID NO: 35131 - RNA, 21 nt, Artificial Sequence
  Marburg virus siRNA sense strand
caauaggaaaucgagcaccgu

SEQ ID NO: 35132 - RNA, 21 nt, Artificial Sequence
  Marburg virus siRNA sense strand
aauaggaaaucgagcaccgua

SEQ ID NO: 35133 - RNA, 21 nt, Artificial Sequence
  Marburg virus siRNA sense strand
auaggaaaucgagcaccguau

SEQ ID NO: 35134 - RNA, 21 nt, Artificial Sequence
  Marburg virus siRNA sense strand
uaggaaaucgagcaccguaua

SEQ ID NO: 35135 - RNA, 21 nt, Artificial Sequence
  Marburg virus siRNA sense strand
aggaaaucgagcaccguauau

SEQ ID NO: 35136 - RNA, 21 nt, Artificial Sequence
  Marburg virus siRNA sense strand
ggaaaucgagcaccguauaua

SEQ ID NO: 35137 - RNA, 21 nt, Artificial Sequence
  Marburg virus siRNA sense strand
gaaaucgagcaccguauauag

SEQ ID NO: 35138 - RNA, 21 nt, Artificial Sequence
  Marburg virus siRNA sense strand
aaaucgagcaccguauauagg

SEQ ID NO: 35139 - RNA, 21 nt, Artificial Sequence
  Marburg virus siRNA sense strand
aaucgagcaccguauauagga

SEQ ID NO: 35140 - RNA, 21 nt, Artificial Sequence
  Marburg virus siRNA sense strand
aucgagcaccguauauaggau

SEQ ID NO: 35141 - RNA, 21 nt, Artificial Sequence
  Marburg virus siRNA sense strand
ucgagcaccguauauaggauc

SEQ ID NO: 35142 - RNA, 21 nt, Artificial Sequence
  Marburg virus siRNA sense strand
cgagcaccguauauaggauca

SEQ ID NO: 35143 - RNA, 21 nt, Artificial Sequence
  Marburg virus siRNA sense strand
gagcaccguauauaggaucac

SEQ ID NO: 35144 - RNA, 21 nt, Artificial Sequence
  Marburg virus siRNA sense strand
agcaccguauauaggaucacg

SEQ ID NO: 35145 - RNA, 21 nt, Artificial Sequence
  Marburg virus siRNA sense strand
gcaccguauauaggaucacgg

SEQ ID NO: 35146 - RNA, 21 nt, Artificial Sequence
  Marburg virus siRNA sense strand
caccguauauaggaucacgga

SEQ ID NO: 35147 - RNA, 21 nt, Artificial Sequence
  Marburg virus siRNA sense strand
accguauauaggaucacggac

SEQ ID NO: 35148 - RNA, 21 nt, Artificial Sequence
  Marburg virus siRNA sense strand
ccguauauaggaucacggaca

SEQ ID NO: 35149 - RNA, 21 nt, Artificial Sequence
  Marburg virus siRNA sense strand
cguauauaggaucacggacag

SEQ ID NO: 35150 - RNA, 21 nt, Artificial Sequence
  Marburg virus siRNA sense strand
guauauaggaucacggacaga

SEQ ID NO: 35151 - RNA, 21 nt, Artificial Sequence
  Marburg virus siRNA sense strand
uauauaggaucacggacagaa

SEQ ID NO: 35152 - RNA, 21 nt, Artificial Sequence
  Marburg virus siRNA sense strand
auauaggaucacggacagaag

SEQ ID NO: 35153 - RNA, 21 nt, Artificial Sequence
  Marburg virus siRNA sense strand
uauaggaucacggacagaaga

SEQ ID NO: 35154 - RNA, 21 nt, Artificial Sequence
  Marburg virus siRNA sense strand
auaggaucacggacagaagac

SEQ ID NO: 35155 - RNA, 21 nt, Artificial Sequence
  Marburg virus siRNA sense strand
uaggaucacggacagaagaca

SEQ ID NO: 35156 - RNA, 21 nt, Artificial Sequence
  Marburg virus siRNA sense strand
aggaucacggacagaagacaa

SEQ ID NO: 35157 - RNA, 21 nt, Artificial Sequence
  Marburg virus siRNA sense strand
ggaucacggacagaagacaag

SEQ ID NO: 35158 - RNA, 21 nt, Artificial Sequence
  Marburg virus siRNA sense strand
gaucacggacagaagacaaga

SEQ ID NO: 35159 - RNA, 21 nt, Artificial Sequence
  Marburg virus siRNA sense strand
aucacggacagaagacaagau

SEQ ID NO: 35160 - RNA, 21 nt, Artificial Sequence
  Marburg virus siRNA sense strand
ucacggacagaagacaagauc

SEQ ID NO: 35161 - RNA, 21 nt, Artificial Sequence
  Marburg virus siRNA sense strand
cacggacagaagacaagaucg

SEQ ID NO: 35162 - RNA, 21 nt, Artificial Sequence
  Marburg virus siRNA sense strand
acggacagaagacaagaucgg

SEQ ID NO: 35163 - RNA, 21 nt, Artificial Sequence
  Marburg virus siRNA sense strand
cggacagaagacaagaucggu

SEQ ID NO: 35164 - RNA, 21 nt, Artificial Sequence
  Marburg virus siRNA sense strand
ggacagaagacaagaucgguu

SEQ ID NO: 35165 - RNA, 21 nt, Artificial Sequence
  Marburg virus siRNA sense strand
gacagaagacaagaucgguua

SEQ ID NO: 35166 - RNA, 21 nt, Artificial Sequence
  Marburg virus siRNA sense strand
acagaagacaagaucgguuau

SEQ ID NO: 35167 - RNA, 21 nt, Artificial Sequence
  Marburg virus siRNA sense strand
cagaagacaagaucgguuauc

SEQ ID NO: 35168 - RNA, 21 nt, Artificial Sequence
  Marburg virus siRNA sense strand
agaagacaagaucgguuaucc

SEQ ID NO: 35169 - RNA, 21 nt, Artificial Sequence
  Marburg virus siRNA sense strand
gaagacaagaucgguuauccu

SEQ ID NO: 35170 - RNA, 21 nt, Artificial Sequence
  Marburg virus siRNA sense strand
aagacaagaucgguuauccuc

SEQ ID NO: 35171 - RNA, 21 nt, Artificial Sequence
  Marburg virus siRNA sense strand
agacaagaucgguuauccucc

SEQ ID NO: 35172 - RNA, 21 nt, Artificial Sequence
  Marburg virus siRNA sense strand
gacaagaucgguuauccuccc

SEQ ID NO: 35173 - RNA, 21 nt, Artificial Sequence
  Marburg virus siRNA sense strand
acaagaucgguuauccucccu

SEQ ID NO: 35174 - RNA, 21 nt, Artificial Sequence
  Marburg virus siRNA sense strand
caagaucgguuauccucccuu

SEQ ID NO: 35175 - RNA, 21 nt, Artificial Sequence
  Marburg virus siRNA sense strand
aagaucgguuauccucccuua

SEQ ID NO: 35176 - RNA, 21 nt, Artificial Sequence
  Marburg virus siRNA sense strand
agaucgguuauccucccuuaa

SEQ ID NO: 35177 - RNA, 21 nt, Artificial Sequence
  Marburg virus siRNA sense strand
gaucgguuauccucccuuaag

SEQ ID NO: 35178 - RNA, 21 nt, Artificial Sequence
  Marburg virus siRNA sense strand
aucgguuauccucccuuaaga

SEQ ID NO: 35179 - RNA, 21 nt, Artificial Sequence
  Marburg virus siRNA sense strand
ucgguuauccucccuuaagag

SEQ ID NO: 35180 - RNA, 21 nt, Artificial Sequence
  Marburg virus siRNA sense strand
cgguuauccucccuuaagagu

SEQ ID NO: 35181 - RNA, 21 nt, Artificial Sequence
  Marburg virus siRNA sense strand
gguuauccucccuuaagagua

SEQ ID NO: 35182 - RNA, 21 nt, Artificial Sequence
  Marburg virus siRNA sense strand
guuauccucccuuaagaguaa

SEQ ID NO: 35183 - RNA, 21 nt, Artificial Sequence
  Marburg virus siRNA sense strand
uuauccucccuuaagaguaaa

SEQ ID NO: 35184 - RNA, 21 nt, Artificial Sequence
  Marburg virus siRNA sense strand
uauccucccuuaagaguaaau

SEQ ID NO: 35185 - RNA, 21 nt, Artificial Sequence
  Marburg virus siRNA sense strand
auccucccuuaagaguaaauu

SEQ ID NO: 35186 - RNA, 21 nt, Artificial Sequence
  Marburg virus siRNA sense strand
uccucccuuaagaguaaauug

SEQ ID NO: 35187 - RNA, 21 nt, Artificial Sequence
  Marburg virus siRNA sense strand
ccucccuuaagaguaaauugu

SEQ ID NO: 35188 - RNA, 21 nt, Artificial Sequence
  Marburg virus siRNA sense strand
cucccuuaagaguaaauuguc

SEQ ID NO: 35189 - RNA, 21 nt, Artificial Sequence
  Marburg virus siRNA sense strand
ucccuuaagaguaaauugucc

SEQ ID NO: 35190 - RNA, 21 nt, Artificial Sequence
  Marburg virus siRNA sense strand
cccuuaagaguaaauugucca

SEQ ID NO: 35191 - RNA, 21 nt, Artificial Sequence
  Marburg virus siRNA sense strand
ccuuaagaguaaauuguccau

SEQ ID NO: 35192 - RNA, 21 nt, Artificial Sequence
  Marburg virus siRNA sense strand
cuuaagaguaaauuguccauc

SEQ ID NO: 35193 - RNA, 21 nt, Artificial Sequence
  Marburg virus siRNA sense strand
uuaagaguaaauuguccauca

SEQ ID NO: 35194 - RNA, 21 nt, Artificial Sequence
  Marburg virus siRNA sense strand
uaagaguaaauuguccaucag

SEQ ID NO: 35195 - RNA, 21 nt, Artificial Sequence
  Marburg virus siRNA sense strand
aagaguaaauuguccaucagc

SEQ ID NO: 35196 - RNA, 21 nt, Artificial Sequence
  Marburg virus siRNA sense strand
agaguaaauuguccaucagcg

SEQ ID NO: 35197 - RNA, 21 nt, Artificial Sequence
  Marburg virus siRNA sense strand
gaguaaauuguccaucagcgg

SEQ ID NO: 35198 - RNA, 21 nt, Artificial Sequence
  Marburg virus siRNA sense strand
aguaaauuguccaucagcggc

SEQ ID NO: 35199 - RNA, 21 nt, Artificial Sequence
  Marburg virus siRNA sense strand
guaaauuguccaucagcggca

SEQ ID NO: 35200 - RNA, 21 nt, Artificial Sequence
  Marburg virus siRNA sense strand
uaaauuguccaucagcggcac

SEQ ID NO: 35201 - RNA, 21 nt, Artificial Sequence
  Marburg virus siRNA sense strand
aaauuguccaucagcggcacu

SEQ ID NO: 35202 - RNA, 21 nt, Artificial Sequence
  Marburg virus siRNA sense strand
aauuguccaucagcggcacuu

SEQ ID NO: 35203 - RNA, 21 nt, Artificial Sequence
  Marburg virus siRNA sense strand
auuguccaucagcggcacuua

SEQ ID NO: 35204 - RNA, 21 nt, Artificial Sequence
  Marburg virus siRNA sense strand
uuguccaucagcggcacuuaa

SEQ ID NO: 35205 - RNA, 21 nt, Artificial Sequence
  Marburg virus siRNA sense strand
uguccaucagcggcacuuaaa

SEQ ID NO: 35206 - RNA, 21 nt, Artificial Sequence
  Marburg virus siRNA sense strand
guccaucagcggcacuuaaag

SEQ ID NO: 35207 - RNA, 21 nt, Artificial Sequence
  Marburg virus siRNA sense strand
uccaucagcggcacuuaaaga

SEQ ID NO: 35208 - RNA, 21 nt, Artificial Sequence
  Marburg virus siRNA sense strand
ccaucagcggcacuuaaagaa

SEQ ID NO: 35209 - RNA, 21 nt, Artificial Sequence
  Marburg virus siRNA sense strand
caucagcggcacuuaaagaag

SEQ ID NO: 35210 - RNA, 21 nt, Artificial Sequence
  Marburg virus siRNA sense strand
aucagcggcacuuaaagaagc

SEQ ID NO: 35211 - RNA, 21 nt, Artificial Sequence
  Marburg virus siRNA sense strand
ucagcggcacuuaaagaagcc

SEQ ID NO: 35212 - RNA, 21 nt, Artificial Sequence
  Marburg virus siRNA sense strand
cagcggcacuuaaagaagcca

SEQ ID NO: 35213 - RNA, 21 nt, Artificial Sequence
  Marburg virus siRNA sense strand
agcggcacuuaaagaagccau

SEQ ID NO: 35214 - RNA, 21 nt, Artificial Sequence
  Marburg virus siRNA sense strand
gcggcacuuaaagaagccauu

SEQ ID NO: 35215 - RNA, 21 nt, Artificial Sequence
  Marburg virus siRNA sense strand
cggcacuuaaagaagccauug

SEQ ID NO: 35216 - RNA, 21 nt, Artificial Sequence
  Marburg virus siRNA sense strand
ggcacuuaaagaagccauuga

SEQ ID NO: 35217 - RNA, 21 nt, Artificial Sequence
  Marburg virus siRNA sense strand
gcacuuaaagaagccauugag

SEQ ID NO: 35218 - RNA, 21 nt, Artificial Sequence
  Marburg virus siRNA sense strand
cacuuaaagaagccauugaga

SEQ ID NO: 35219 - RNA, 21 nt, Artificial Sequence
  Marburg virus siRNA sense strand
acuuaaagaagccauugagau

SEQ ID NO: 35220 - RNA, 21 nt, Artificial Sequence
  Marburg virus siRNA sense strand
cuuaaagaagccauugagaug

SEQ ID NO: 35221 - RNA, 21 nt, Artificial Sequence
  Marburg virus siRNA sense strand
uuaaagaagccauugagaugg

SEQ ID NO: 35222 - RNA, 21 nt, Artificial Sequence
  Marburg virus siRNA sense strand
uaaagaagccauugagauggu

SEQ ID NO: 35223 - RNA, 21 nt, Artificial Sequence
  Marburg virus siRNA sense strand
aaagaagccauugagaugguu

SEQ ID NO: 35224 - RNA, 21 nt, Artificial Sequence
  Marburg virus siRNA sense strand
aagaagccauugagaugguuu

SEQ ID NO: 35225 - RNA, 21 nt, Artificial Sequence
  Marburg virus siRNA sense strand
agaagccauugagaugguuuc

SEQ ID NO: 35226 - RNA, 21 nt, Artificial Sequence
  Marburg virus siRNA sense strand
gaagccauugagaugguuucu

SEQ ID NO: 35227 - RNA, 21 nt, Artificial Sequence
  Marburg virus siRNA sense strand
aagccauugagaugguuucua

SEQ ID NO: 35228 - RNA, 21 nt, Artificial Sequence
  Marburg virus siRNA sense strand
agccauugagaugguuucuag

SEQ ID NO: 35229 - RNA, 21 nt, Artificial Sequence
  Marburg virus siRNA sense strand
gccauugagaugguuucuaga

SEQ ID NO: 35230 - RNA, 21 nt, Artificial Sequence
  Marburg virus siRNA sense strand
ccauugagaugguuucuagau

SEQ ID NO: 35231 - RNA, 21 nt, Artificial Sequence
  Marburg virus siRNA sense strand
cauugagaugguuucuagauu

SEQ ID NO: 35232 - RNA, 21 nt, Artificial Sequence
  Marburg virus siRNA sense strand
auugagaugguuucuagauug

SEQ ID NO: 35233 - RNA, 21 nt, Artificial Sequence
  Marburg virus siRNA sense strand
uugagaugguuucuagauugu

SEQ ID NO: 35234 - RNA, 21 nt, Artificial Sequence
  Marburg virus siRNA sense strand
ugagaugguuucuagauuguu

SEQ ID NO: 35235 - RNA, 21 nt, Artificial Sequence
  Marburg virus siRNA sense strand
gagaugguuucuagauuguug

SEQ ID NO: 35236 - RNA, 21 nt, Artificial Sequence
  Marburg virus siRNA sense strand
agaugguuucuagauuguugu

SEQ ID NO: 35237 - RNA, 21 nt, Artificial Sequence
  Marburg virus siRNA sense strand
gaugguuucuagauuguugug

SEQ ID NO: 35238 - RNA, 21 nt, Artificial Sequence
  Marburg virus siRNA sense strand
augguuucuagauuguugugg

SEQ ID NO: 35239 - RNA, 21 nt, Artificial Sequence
  Marburg virus siRNA sense strand
ugguuucuagauuguuguggg

SEQ ID NO: 35240 - RNA, 21 nt, Artificial Sequence
  Marburg virus siRNA sense strand
gguuucuagauuguugugggu

SEQ ID NO: 35241 - RNA, 21 nt, Artificial Sequence
  Marburg virus siRNA sense strand
guuucuagauuguugugggug

SEQ ID NO: 35242 - RNA, 21 nt, Artificial Sequence
  Marburg virus siRNA sense strand
uuucuagauuguuguggguga

SEQ ID NO: 35243 - RNA, 21 nt, Artificial Sequence
  Marburg virus siRNA sense strand
uucuagauuguugugggugac

SEQ ID NO: 35244 - RNA, 21 nt, Artificial Sequence
  Marburg virus siRNA sense strand
ucuagauuguugugggugacu

SEQ ID NO: 35245 - RNA, 21 nt, Artificial Sequence
  Marburg virus siRNA sense strand
cuagauuguugugggugacuc

SEQ ID NO: 35246 - RNA, 21 nt, Artificial Sequence
  Marburg virus siRNA sense strand
uagauuguugugggugacuca

SEQ ID NO: 35247 - RNA, 21 nt, Artificial Sequence
  Marburg virus siRNA sense strand
agauuguugugggugacucaa

SEQ ID NO: 35248 - RNA, 21 nt, Artificial Sequence
  Marburg virus siRNA sense strand
gauuguugugggugacucaag

SEQ ID NO: 35249 - RNA, 21 nt, Artificial Sequence
  Marburg virus siRNA sense strand
auuguugugggugacucaagg

SEQ ID NO: 35250 - RNA, 21 nt, Artificial Sequence
  Marburg virus siRNA sense strand
uuguugugggugacucaaggc

SEQ ID NO: 35251 - RNA, 21 nt, Artificial Sequence
  Marburg virus siRNA sense strand
uguugugggugacucaaggca

SEQ ID NO: 35252 - RNA, 21 nt, Artificial Sequence
  Marburg virus siRNA sense strand
guugugggugacucaaggcac

SEQ ID NO: 35253 - RNA, 21 nt, Artificial Sequence
  Marburg virus siRNA sense strand
uugugggugacucaaggcacu

SEQ ID NO: 35254 - RNA, 21 nt, Artificial Sequence
  Marburg virus siRNA sense strand
ugugggugacucaaggcacug

SEQ ID NO: 35255 - RNA, 21 nt, Artificial Sequence
  Marburg virus siRNA sense strand
gugggugacucaaggcacugc

SEQ ID NO: 35256 - RNA, 21 nt, Artificial Sequence
  Marburg virus siRNA sense strand
ugggugacucaaggcacugca

SEQ ID NO: 35257 - RNA, 21 nt, Artificial Sequence
  Marburg virus siRNA sense strand
gggugacucaaggcacugcag

SEQ ID NO: 35258 - RNA, 21 nt, Artificial Sequence
  Marburg virus siRNA sense strand
ggugacucaaggcacugcaga

SEQ ID NO: 35259 - RNA, 21 nt, Artificial Sequence
  Marburg virus siRNA sense strand
gugacucaaggcacugcagac

SEQ ID NO: 35260 - RNA, 21 nt, Artificial Sequence
  Marburg virus siRNA sense strand
ugacucaaggcacugcagacc

SEQ ID NO: 35261 - RNA, 21 nt, Artificial Sequence
  Marburg virus siRNA sense strand
gacucaaggcacugcagaccg

SEQ ID NO: 35262 - RNA, 21 nt, Artificial Sequence
  Marburg virus siRNA sense strand
acucaaggcacugcagaccga

SEQ ID NO: 35263 - RNA, 21 nt, Artificial Sequence
  Marburg virus siRNA sense strand
cucaaggcacugcagaccgag

SEQ ID NO: 35264 - RNA, 21 nt, Artificial Sequence
  Marburg virus siRNA sense strand
ucaaggcacugcagaccgaga

SEQ ID NO: 35265 - RNA, 21 nt, Artificial Sequence
  Marburg virus siRNA sense strand
caaggcacugcagaccgagaa

SEQ ID NO: 35266 - RNA, 21 nt, Artificial Sequence
  Marburg virus siRNA sense strand
aaggcacugcagaccgagaaa

SEQ ID NO: 35267 - RNA, 21 nt, Artificial Sequence
  Marburg virus siRNA sense strand
aggcacugcagaccgagaaaa

SEQ ID NO: 35268 - RNA, 21 nt, Artificial Sequence
  Marburg virus siRNA sense strand
ggcacugcagaccgagaaaaa

SEQ ID NO: 35269 - RNA, 21 nt, Artificial Sequence
  Marburg virus siRNA sense strand
gcacugcagaccgagaaaaau

SEQ ID NO: 35270 - RNA, 21 nt, Artificial Sequence
  Marburg virus siRNA sense strand
cacugcagaccgagaaaaauu

SEQ ID NO: 35271 - RNA, 21 nt, Artificial Sequence
  Marburg virus siRNA sense strand
acugcagaccgagaaaaauug

SEQ ID NO: 35272 - RNA, 21 nt, Artificial Sequence
  Marburg virus siRNA sense strand
cugcagaccgagaaaaauugc

SEQ ID NO: 35273 - RNA, 21 nt, Artificial Sequence
  Marburg virus siRNA sense strand
ugcagaccgagaaaaauugcu

SEQ ID NO: 35274 - RNA, 21 nt, Artificial Sequence
  Marburg virus siRNA sense strand
gcagaccgagaaaaauugcuu

SEQ ID NO: 35275 - RNA, 21 nt, Artificial Sequence
  Marburg virus siRNA sense strand
cagaccgagaaaaauugcuua

SEQ ID NO: 35276 - RNA, 21 nt, Artificial Sequence
  Marburg virus siRNA sense strand
agaccgagaaaaauugcuuau

SEQ ID NO: 35277 - RNA, 21 nt, Artificial Sequence
  Marburg virus siRNA sense strand
gaccgagaaaaauugcuuauu

SEQ ID NO: 35278 - RNA, 21 nt, Artificial Sequence
  Marburg virus siRNA sense strand
accgagaaaaauugcuuauuc

SEQ ID NO: 35279 - RNA, 21 nt, Artificial Sequence
  Marburg virus siRNA sense strand
ccgagaaaaauugcuuauucc

SEQ ID NO: 35280 - RNA, 21 nt, Artificial Sequence
  Marburg virus siRNA sense strand
cgagaaaaauugcuuauuccu

SEQ ID NO: 35281 - RNA, 21 nt, Artificial Sequence
  Marburg virus siRNA sense strand
gagaaaaauugcuuauuccuc

SEQ ID NO: 35282 - RNA, 21 nt, Artificial Sequence
  Marburg virus siRNA sense strand
agaaaaauugcuuauuccucu

SEQ ID NO: 35283 - RNA, 21 nt, Artificial Sequence
  Marburg virus siRNA sense strand
gaaaaauugcuuauuccucuc

SEQ ID NO: 35284 - RNA, 21 nt, Artificial Sequence
  Marburg virus siRNA sense strand
aaaaauugcuuauuccucucc

SEQ ID NO: 35285 - RNA, 21 nt, Artificial Sequence
  Marburg virus siRNA sense strand
aaaauugcuuauuccucuccu

SEQ ID NO: 35286 - RNA, 21 nt, Artificial Sequence
  Marburg virus siRNA sense strand
aaauugcuuauuccucuccuc

SEQ ID NO: 35287 - RNA, 21 nt, Artificial Sequence
  Marburg virus siRNA sense strand
aauugcuuauuccucuccuca

SEQ ID NO: 35288 - RNA, 21 nt, Artificial Sequence
  Marburg virus siRNA sense strand
auugcuuauuccucuccucaa

SEQ ID NO: 35289 - RNA, 21 nt, Artificial Sequence
  Marburg virus siRNA sense strand
uugcuuauuccucuccucaau

SEQ ID NO: 35290 - RNA, 21 nt, Artificial Sequence
  Marburg virus siRNA sense strand
ugcuuauuccucuccucaauu

SEQ ID NO: 35291 - RNA, 21 nt, Artificial Sequence
  Marburg virus siRNA sense strand
gcuuauuccucuccucaauuc

SEQ ID NO: 35292 - RNA, 21 nt, Artificial Sequence
  Marburg virus siRNA sense strand
cuuauuccucuccucaauucg

SEQ ID NO: 35293 - RNA, 21 nt, Artificial Sequence
  Marburg virus siRNA sense strand
uuauuccucuccucaauucga

SEQ ID NO: 35294 - RNA, 21 nt, Artificial Sequence
  Marburg virus siRNA sense strand
uauuccucuccucaauucgag

SEQ ID NO: 35295 - RNA, 21 nt, Artificial Sequence
  Marburg virus siRNA sense strand
auuccucuccucaauucgagg

SEQ ID NO: 35296 - RNA, 21 nt, Artificial Sequence
  Marburg virus siRNA sense strand
uuccucuccucaauucgaggg

SEQ ID NO: 35297 - RNA, 21 nt, Artificial Sequence
  Marburg virus siRNA sense strand
uccucuccucaauucgagggu

SEQ ID NO: 35298 - RNA, 21 nt, Artificial Sequence
  Marburg virus siRNA sense strand
ccucuccucaauucgagggua

SEQ ID NO: 35299 - RNA, 21 nt, Artificial Sequence
  Marburg virus siRNA sense strand
cucuccucaauucgaggguaa

SEQ ID NO: 35300 - RNA, 21 nt, Artificial Sequence
  Marburg virus siRNA sense strand
ucuccucaauucgaggguaaa

SEQ ID NO: 35301 - RNA, 21 nt, Artificial Sequence
  Marburg virus siRNA sense strand
cuccucaauucgaggguaaau

SEQ ID NO: 35302 - RNA, 21 nt, Artificial Sequence
  Marburg virus siRNA sense strand
uccucaauucgaggguaaauc

SEQ ID NO: 35303 - RNA, 21 nt, Artificial Sequence
  Marburg virus siRNA sense strand
ccucaauucgaggguaaaucu

SEQ ID NO: 35304 - RNA, 21 nt, Artificial Sequence
  Marburg virus siRNA sense strand
cucaauucgaggguaaaucug

SEQ ID NO: 35305 - RNA, 21 nt, Artificial Sequence
  Marburg virus siRNA sense strand
ucaauucgaggguaaaucugg

SEQ ID NO: 35306 - RNA, 21 nt, Artificial Sequence
  Marburg virus siRNA sense strand
caauucgaggguaaaucugga

SEQ ID NO: 35307 - RNA, 21 nt, Artificial Sequence
  Marburg virus siRNA sense strand
aauucgaggguaaaucuggac

SEQ ID NO: 35308 - RNA, 21 nt, Artificial Sequence
  Marburg virus siRNA sense strand
auucgaggguaaaucuggacu

SEQ ID NO: 35309 - RNA, 21 nt, Artificial Sequence
  Marburg virus siRNA sense strand
uucgaggguaaaucuggacua

SEQ ID NO: 35310 - RNA, 21 nt, Artificial Sequence
  Marburg virus siRNA sense strand
ucgaggguaaaucuggacuau

SEQ ID NO: 35311 - RNA, 21 nt, Artificial Sequence
  Marburg virus siRNA sense strand
cgaggguaaaucuggacuauc

SEQ ID NO: 35312 - RNA, 21 nt, Artificial Sequence
  Marburg virus siRNA sense strand
gaggguaaaucuggacuauca

SEQ ID NO: 35313 - RNA, 21 nt, Artificial Sequence
  Marburg virus siRNA sense strand
aggguaaaucuggacuaucag

SEQ ID NO: 35314 - RNA, 21 nt, Artificial Sequence
  Marburg virus siRNA sense strand
ggguaaaucuggacuaucaga

SEQ ID NO: 35315 - RNA, 21 nt, Artificial Sequence
  Marburg virus siRNA sense strand
gguaaaucuggacuaucagac

SEQ ID NO: 35316 - RNA, 21 nt, Artificial Sequence
  Marburg virus siRNA sense strand
guaaaucuggacuaucagaca

SEQ ID NO: 35317 - RNA, 21 nt, Artificial Sequence
  Marburg virus siRNA sense strand
uaaaucuggacuaucagacag

SEQ ID NO: 35318 - RNA, 21 nt, Artificial Sequence
  Marburg virus siRNA sense strand
aaaucuggacuaucagacagu

SEQ ID NO: 35319 - RNA, 21 nt, Artificial Sequence
  Marburg virus siRNA sense strand
aaucuggacuaucagacagug

SEQ ID NO: 35320 - RNA, 21 nt, Artificial Sequence
  Marburg virus siRNA sense strand
aucuggacuaucagacagugc

SEQ ID NO: 35321 - RNA, 21 nt, Artificial Sequence
  Marburg virus siRNA sense strand
ucuggacuaucagacagugcu

SEQ ID NO: 35322 - RNA, 21 nt, Artificial Sequence
  Marburg virus siRNA sense strand
cuggacuaucagacagugcuu

SEQ ID NO: 35323 - RNA, 21 nt, Artificial Sequence
  Marburg virus siRNA sense strand
uggacuaucagacagugcuua

SEQ ID NO: 35324 - RNA, 21 nt, Artificial Sequence
  Marburg virus siRNA sense strand
ggacuaucagacagugcuuaa

SEQ ID NO: 35325 - RNA, 21 nt, Artificial Sequence
  Marburg virus siRNA sense strand
gacuaucagacagugcuuaac

SEQ ID NO: 35326 - RNA, 21 nt, Artificial Sequence
  Marburg virus siRNA sense strand
acuaucagacagugcuuaacu

SEQ ID NO: 35327 - RNA, 21 nt, Artificial Sequence
  Marburg virus siRNA sense strand
cuaucagacagugcuuaacuu

SEQ ID NO: 35328 - RNA, 21 nt, Artificial Sequence
  Marburg virus siRNA sense strand
uaucagacagugcuuaacuuu

SEQ ID NO: 35329 - RNA, 21 nt, Artificial Sequence
  Marburg virus siRNA sense strand
aucagacagugcuuaacuuuu

SEQ ID NO: 35330 - RNA, 21 nt, Artificial Sequence
  Marburg virus siRNA sense strand
ucagacagugcuuaacuuuuu

SEQ ID NO: 35331 - RNA, 21 nt, Artificial Sequence
  Marburg virus siRNA sense strand
cagacagugcuuaacuuuuua

SEQ ID NO: 35332 - RNA, 21 nt, Artificial Sequence
  Marburg virus siRNA sense strand
agacagugcuuaacuuuuuac

SEQ ID NO: 35333 - RNA, 21 nt, Artificial Sequence
  Marburg virus siRNA sense strand
gacagugcuuaacuuuuuacc

SEQ ID NO: 35334 - RNA, 21 nt, Artificial Sequence
  Marburg virus siRNA sense strand
acagugcuuaacuuuuuaccu

SEQ ID NO: 35335 - RNA, 21 nt, Artificial Sequence
  Marburg virus siRNA sense strand
cagugcuuaacuuuuuaccua

SEQ ID NO: 35336 - RNA, 21 nt, Artificial Sequence
  Marburg virus siRNA sense strand
agugcuuaacuuuuuaccuac

SEQ ID NO: 35337 - RNA, 21 nt, Artificial Sequence
  Marburg virus siRNA sense strand
gugcuuaacuuuuuaccuaca

SEQ ID NO: 35338 - RNA, 21 nt, Artificial Sequence
  Marburg virus siRNA sense strand
ugcuuaacuuuuuaccuacac

SEQ ID NO: 35339 - RNA, 21 nt, Artificial Sequence
  Marburg virus siRNA sense strand
gcuuaacuuuuuaccuacaca

SEQ ID NO: 35340 - RNA, 21 nt, Artificial Sequence
  Marburg virus siRNA sense strand
cuuaacuuuuuaccuacacac

SEQ ID NO: 35341 - RNA, 21 nt, Artificial Sequence
  Marburg virus siRNA sense strand
uuaacuuuuuaccuacacacu

SEQ ID NO: 35342 - RNA, 21 nt, Artificial Sequence
  Marburg virus siRNA sense strand
uaacuuuuuaccuacacacua

SEQ ID NO: 35343 - RNA, 21 nt, Artificial Sequence
  Marburg virus siRNA sense strand
aacuuuuuaccuacacacuac

SEQ ID NO: 35344 - RNA, 21 nt, Artificial Sequence
  Marburg virus siRNA sense strand
acuuuuuaccuacacacuacu

SEQ ID NO: 35345 - RNA, 21 nt, Artificial Sequence
  Marburg virus siRNA sense strand
cuuuuuaccuacacacuacuc

SEQ ID NO: 35346 - RNA, 21 nt, Artificial Sequence
  Marburg virus siRNA sense strand
uuuuuaccuacacacuacuca

SEQ ID NO: 35347 - RNA, 21 nt, Artificial Sequence
  Marburg virus siRNA sense strand
uuuuaccuacacacuacucag

SEQ ID NO: 35348 - RNA, 21 nt, Artificial Sequence
  Marburg virus siRNA sense strand
uuuaccuacacacuacucagg

SEQ ID NO: 35349 - RNA, 21 nt, Artificial Sequence
  Marburg virus siRNA sense strand
uuaccuacacacuacucaggc

SEQ ID NO: 35350 - RNA, 21 nt, Artificial Sequence
  Marburg virus siRNA sense strand
uaccuacacacuacucaggca

SEQ ID NO: 35351 - RNA, 21 nt, Artificial Sequence
  Marburg virus siRNA sense strand
accuacacacuacucaggcaa

SEQ ID NO: 35352 - RNA, 21 nt, Artificial Sequence
  Marburg virus siRNA sense strand
ccuacacacuacucaggcaac

SEQ ID NO: 35353 - RNA, 21 nt, Artificial Sequence
  Marburg virus siRNA sense strand
cuacacacuacucaggcaaca

SEQ ID NO: 35354 - RNA, 21 nt, Artificial Sequence
  Marburg virus siRNA sense strand
uacacacuacucaggcaacau

SEQ ID NO: 35355 - RNA, 21 nt, Artificial Sequence
  Marburg virus siRNA sense strand
acacacuacucaggcaacaua

SEQ ID NO: 35356 - RNA, 21 nt, Artificial Sequence
  Marburg virus siRNA sense strand
cacacuacucaggcaacauag

SEQ ID NO: 35357 - RNA, 21 nt, Artificial Sequence
  Marburg virus siRNA sense strand
acacuacucaggcaacauagu

SEQ ID NO: 35358 - RNA, 21 nt, Artificial Sequence
  Marburg virus siRNA sense strand
cacuacucaggcaacauaguu

SEQ ID NO: 35359 - RNA, 21 nt, Artificial Sequence
  Marburg virus siRNA sense strand
acuacucaggcaacauaguuc

SEQ ID NO: 35360 - RNA, 21 nt, Artificial Sequence
  Marburg virus siRNA sense strand
cuacucaggcaacauaguuca

SEQ ID NO: 35361 - RNA, 21 nt, Artificial Sequence
  Marburg virus siRNA sense strand
uacucaggcaacauaguucau

SEQ ID NO: 35362 - RNA, 21 nt, Artificial Sequence
  Marburg virus siRNA sense strand
acucaggcaacauaguucaua

SEQ ID NO: 35363 - RNA, 21 nt, Artificial Sequence
  Marburg virus siRNA sense strand
cucaggcaacauaguucauag

SEQ ID NO: 35364 - RNA, 21 nt, Artificial Sequence
  Marburg virus siRNA sense strand
ucaggcaacauaguucauaga

SEQ ID NO: 35365 - RNA, 21 nt, Artificial Sequence
  Marburg virus siRNA sense strand
caggcaacauaguucauagau

SEQ ID NO: 35366 - RNA, 21 nt, Artificial Sequence
  Marburg virus siRNA sense strand
aggcaacauaguucauagaua

SEQ ID NO: 35367 - RNA, 21 nt, Artificial Sequence
  Marburg virus siRNA sense strand
ggcaacauaguucauagauau

SEQ ID NO: 35368 - RNA, 21 nt, Artificial Sequence
  Marburg virus siRNA sense strand
gcaacauaguucauagauaua

SEQ ID NO: 35369 - RNA, 21 nt, Artificial Sequence
  Marburg virus siRNA sense strand
caacauaguucauagauauaa

SEQ ID NO: 35370 - RNA, 21 nt, Artificial Sequence
  Marburg virus siRNA sense strand
aacauaguucauagauauaau

SEQ ID NO: 35371 - RNA, 21 nt, Artificial Sequence
  Marburg virus siRNA sense strand
acauaguucauagauauaaug

SEQ ID NO: 35372 - RNA, 21 nt, Artificial Sequence
  Marburg virus siRNA sense strand
cauaguucauagauauaauga

SEQ ID NO: 35373 - RNA, 21 nt, Artificial Sequence
  Marburg virus siRNA sense strand
auaguucauagauauaaugac

SEQ ID NO: 35374 - RNA, 21 nt, Artificial Sequence
  Marburg virus siRNA sense strand
uaguucauagauauaaugacc

SEQ ID NO: 35375 - RNA, 21 nt, Artificial Sequence
  Marburg virus siRNA sense strand
aguucauagauauaaugacca

SEQ ID NO: 35376 - RNA, 21 nt, Artificial Sequence
  Marburg virus siRNA sense strand
guucauagauauaaugaccaa

SEQ ID NO: 35377 - RNA, 21 nt, Artificial Sequence
  Marburg virus siRNA sense strand
uucauagauauaaugaccaau

SEQ ID NO: 35378 - RNA, 21 nt, Artificial Sequence
  Marburg virus siRNA sense strand
ucauagauauaaugaccaaua

SEQ ID NO: 35379 - RNA, 21 nt, Artificial Sequence
  Marburg virus siRNA sense strand
cauagauauaaugaccaauau

SEQ ID NO: 35380 - RNA, 21 nt, Artificial Sequence
  Marburg virus siRNA sense strand
auagauauaaugaccaauaug

SEQ ID NO: 35381 - RNA, 21 nt, Artificial Sequence
  Marburg virus siRNA sense strand
uagauauaaugaccaauaugg

SEQ ID NO: 35382 - RNA, 21 nt, Artificial Sequence
  Marburg virus siRNA sense strand
agauauaaugaccaauaugga

SEQ ID NO: 35383 - RNA, 21 nt, Artificial Sequence
  Marburg virus siRNA sense strand
gauauaaugaccaauauggac

SEQ ID NO: 35384 - RNA, 21 nt, Artificial Sequence
  Marburg virus siRNA sense strand
auauaaugaccaauauggaca

SEQ ID NO: 35385 - RNA, 21 nt, Artificial Sequence
  Marburg virus siRNA sense strand
uauaaugaccaauauggacaa

SEQ ID NO: 35386 - RNA, 21 nt, Artificial Sequence
  Marburg virus siRNA sense strand
auaaugaccaauauggacaac

SEQ ID NO: 35387 - RNA, 21 nt, Artificial Sequence
  Marburg virus siRNA sense strand
uaaugaccaauauggacaaca

SEQ ID NO: 35388 - RNA, 21 nt, Artificial Sequence
  Marburg virus siRNA sense strand
aaugaccaauauggacaacau

SEQ ID NO: 35389 - RNA, 21 nt, Artificial Sequence
  Marburg virus siRNA sense strand
augaccaauauggacaacauu

SEQ ID NO: 35390 - RNA, 21 nt, Artificial Sequence
  Marburg virus siRNA sense strand
ugaccaauauggacaacauuc

SEQ ID NO: 35391 - RNA, 21 nt, Artificial Sequence
  Marburg virus siRNA sense strand
gaccaauauggacaacauucc

SEQ ID NO: 35392 - RNA, 21 nt, Artificial Sequence
  Marburg virus siRNA sense strand
accaauauggacaacauuccu

SEQ ID NO: 35393 - RNA, 21 nt, Artificial Sequence
  Marburg virus siRNA sense strand
ccaauauggacaacauuccuu

SEQ ID NO: 35394 - RNA, 21 nt, Artificial Sequence
  Marburg virus siRNA sense strand
caauauggacaacauuccuuu

SEQ ID NO: 35395 - RNA, 21 nt, Artificial Sequence
  Marburg virus siRNA sense strand
aauauggacaacauuccuuua

SEQ ID NO: 35396 - RNA, 21 nt, Artificial Sequence
  Marburg virus siRNA sense strand
auauggacaacauuccuuuau

SEQ ID NO: 35397 - RNA, 21 nt, Artificial Sequence
  Marburg virus siRNA sense strand
uauggacaacauuccuuuaug

SEQ ID NO: 35398 - RNA, 21 nt, Artificial Sequence
  Marburg virus siRNA sense strand
auggacaacauuccuuuaugg

SEQ ID NO: 35399 - RNA, 21 nt, Artificial Sequence
  Marburg virus siRNA sense strand
uggacaacauuccuuuauggc

SEQ ID NO: 35400 - RNA, 21 nt, Artificial Sequence
  Marburg virus siRNA sense strand
ggacaacauuccuuuauggca

SEQ ID NO: 35401 - RNA, 21 nt, Artificial Sequence
  Marburg virus siRNA sense strand
gacaacauuccuuuauggcaa

SEQ ID NO: 35402 - RNA, 21 nt, Artificial Sequence
  Marburg virus siRNA sense strand
acaacauuccuuuauggcaaa

SEQ ID NO: 35403 - RNA, 21 nt, Artificial Sequence
  Marburg virus siRNA sense strand
caacauuccuuuauggcaaac

SEQ ID NO: 35404 - RNA, 21 nt, Artificial Sequence
  Marburg virus siRNA sense strand
aacauuccuuuauggcaaaca

SEQ ID NO: 35405 - RNA, 21 nt, Artificial Sequence
  Marburg virus siRNA sense strand
acauuccuuuauggcaaacag

SEQ ID NO: 35406 - RNA, 21 nt, Artificial Sequence
  Marburg virus siRNA sense strand
cauuccuuuauggcaaacagg

SEQ ID NO: 35407 - RNA, 21 nt, Artificial Sequence
  Marburg virus siRNA sense strand
auuccuuuauggcaaacagga

SEQ ID NO: 35408 - RNA, 21 nt, Artificial Sequence
  Marburg virus siRNA sense strand
uuccuuuauggcaaacaggau

SEQ ID NO: 35409 - RNA, 21 nt, Artificial Sequence
  Marburg virus siRNA sense strand
uccuuuauggcaaacaggaug

SEQ ID NO: 35410 - RNA, 21 nt, Artificial Sequence
  Marburg virus siRNA sense strand
ccuuuauggcaaacaggauga

SEQ ID NO: 35411 - RNA, 21 nt, Artificial Sequence
  Marburg virus siRNA sense strand
cuuuauggcaaacaggaugag

SEQ ID NO: 35412 - RNA, 21 nt, Artificial Sequence
  Marburg virus siRNA sense strand
uuuauggcaaacaggaugagu

SEQ ID NO: 35413 - RNA, 21 nt, Artificial Sequence
  Marburg virus siRNA sense strand
uuauggcaaacaggaugagua

SEQ ID NO: 35414 - RNA, 21 nt, Artificial Sequence
  Marburg virus siRNA sense strand
uauggcaaacaggaugaguaa

SEQ ID NO: 35415 - RNA, 21 nt, Artificial Sequence
  Marburg virus siRNA sense strand
auggcaaacaggaugaguaau

SEQ ID NO: 35416 - RNA, 21 nt, Artificial Sequence
  Marburg virus siRNA sense strand
uggcaaacaggaugaguaaua

SEQ ID NO: 35417 - RNA, 21 nt, Artificial Sequence
  Marburg virus siRNA sense strand
ggcaaacaggaugaguaauac

SEQ ID NO: 35418 - RNA, 21 nt, Artificial Sequence
  Marburg virus siRNA sense strand
gcaaacaggaugaguaauaca

SEQ ID NO: 35419 - RNA, 21 nt, Artificial Sequence
  Marburg virus siRNA sense strand
caaacaggaugaguaauacau

SEQ ID NO: 35420 - RNA, 21 nt, Artificial Sequence
  Marburg virus siRNA sense strand
aaacaggaugaguaauacauc

SEQ ID NO: 35421 - RNA, 21 nt, Artificial Sequence
  Marburg virus siRNA sense strand
aacaggaugaguaauacaucu

SEQ ID NO: 35422 - RNA, 21 nt, Artificial Sequence
  Marburg virus siRNA sense strand
acaggaugaguaauacaucua

SEQ ID NO: 35423 - RNA, 21 nt, Artificial Sequence
  Marburg virus siRNA sense strand
caggaugaguaauacaucuac

SEQ ID NO: 35424 - RNA, 21 nt, Artificial Sequence
  Marburg virus siRNA sense strand
aggaugaguaauacaucuaca

SEQ ID NO: 35425 - RNA, 21 nt, Artificial Sequence
  Marburg virus siRNA sense strand
ggaugaguaauacaucuacac

SEQ ID NO: 35426 - RNA, 21 nt, Artificial Sequence
  Marburg virus siRNA sense strand
gaugaguaauacaucuacacg

SEQ ID NO: 35427 - RNA, 21 nt, Artificial Sequence
  Marburg virus siRNA sense strand
augaguaauacaucuacacgu

SEQ ID NO: 35428 - RNA, 21 nt, Artificial Sequence
  Marburg virus siRNA sense strand
ugaguaauacaucuacacgug

SEQ ID NO: 35429 - RNA, 21 nt, Artificial Sequence
  Marburg virus siRNA sense strand
gaguaauacaucuacacgugc

SEQ ID NO: 35430 - RNA, 21 nt, Artificial Sequence
  Marburg virus siRNA sense strand
aguaauacaucuacacgugca

SEQ ID NO: 35431 - RNA, 21 nt, Artificial Sequence
  Marburg virus siRNA sense strand
guaauacaucuacacgugcaa

SEQ ID NO: 35432 - RNA, 21 nt, Artificial Sequence
  Marburg virus siRNA sense strand
uaauacaucuacacgugcaau

SEQ ID NO: 35433 - RNA, 21 nt, Artificial Sequence
  Marburg virus siRNA sense strand
aauacaucuacacgugcaauu

SEQ ID NO: 35434 - RNA, 21 nt, Artificial Sequence
  Marburg virus siRNA sense strand
auacaucuacacgugcaauua

SEQ ID NO: 35435 - RNA, 21 nt, Artificial Sequence
  Marburg virus siRNA sense strand
uacaucuacacgugcaauuau

SEQ ID NO: 35436 - RNA, 21 nt, Artificial Sequence
  Marburg virus siRNA sense strand
acaucuacacgugcaauuaua

SEQ ID NO: 35437 - RNA, 21 nt, Artificial Sequence
  Marburg virus siRNA sense strand
caucuacacgugcaauuauau

SEQ ID NO: 35438 - RNA, 21 nt, Artificial Sequence
  Marburg virus siRNA sense strand
aucuacacgugcaauuauauc

SEQ ID NO: 35439 - RNA, 21 nt, Artificial Sequence
  Marburg virus siRNA sense strand
ucuacacgugcaauuauauca

SEQ ID NO: 35440 - RNA, 21 nt, Artificial Sequence
  Marburg virus siRNA sense strand
cuacacgugcaauuauaucaa

SEQ ID NO: 35441 - RNA, 21 nt, Artificial Sequence
  Marburg virus siRNA sense strand
uacacgugcaauuauaucaac

SEQ ID NO: 35442 - RNA, 21 nt, Artificial Sequence
  Marburg virus siRNA sense strand
acacgugcaauuauaucaacu

SEQ ID NO: 35443 - RNA, 21 nt, Artificial Sequence
  Marburg virus siRNA sense strand
cacgugcaauuauaucaacua

SEQ ID NO: 35444 - RNA, 21 nt, Artificial Sequence
  Marburg virus siRNA sense strand
acgugcaauuauaucaacuaa

SEQ ID NO: 35445 - RNA, 21 nt, Artificial Sequence
  Marburg virus siRNA sense strand
cgugcaauuauaucaacuaac

SEQ ID NO: 35446 - RNA, 21 nt, Artificial Sequence
  Marburg virus siRNA sense strand
gugcaauuauaucaacuaaca

SEQ ID NO: 35447 - RNA, 21 nt, Artificial Sequence
  Marburg virus siRNA sense strand
ugcaauuauaucaacuaacac

SEQ ID NO: 35448 - RNA, 21 nt, Artificial Sequence
  Marburg virus siRNA sense strand
gcaauuauaucaacuaacaca

SEQ ID NO: 35449 - RNA, 21 nt, Artificial Sequence
  Marburg virus siRNA sense strand
caauuauaucaacuaacacac

SEQ ID NO: 35450 - RNA, 21 nt, Artificial Sequence
  Marburg virus siRNA sense strand
aauuauaucaacuaacacacu

SEQ ID NO: 35451 - RNA, 21 nt, Artificial Sequence
  Marburg virus siRNA sense strand
auuauaucaacuaacacacug

SEQ ID NO: 35452 - RNA, 21 nt, Artificial Sequence
  Marburg virus siRNA sense strand
uuauaucaacuaacacacugg

SEQ ID NO: 35453 - RNA, 21 nt, Artificial Sequence
  Marburg virus siRNA sense strand
uauaucaacuaacacacuggg

SEQ ID NO: 35454 - RNA, 21 nt, Artificial Sequence
  Marburg virus siRNA sense strand
auaucaacuaacacacugggc

SEQ ID NO: 35455 - RNA, 21 nt, Artificial Sequence
  Marburg virus siRNA sense strand
uaucaacuaacacacugggca

SEQ ID NO: 35456 - RNA, 21 nt, Artificial Sequence
  Marburg virus siRNA sense strand
aucaacuaacacacugggcaa

SEQ ID NO: 35457 - RNA, 21 nt, Artificial Sequence
  Marburg virus siRNA sense strand
ucaacuaacacacugggcaaa

SEQ ID NO: 35458 - RNA, 21 nt, Artificial Sequence
  Marburg virus siRNA sense strand
caacuaacacacugggcaaau

SEQ ID NO: 35459 - RNA, 21 nt, Artificial Sequence
  Marburg virus siRNA sense strand
aacuaacacacugggcaaaua

SEQ ID NO: 35460 - RNA, 21 nt, Artificial Sequence
  Marburg virus siRNA sense strand
acuaacacacugggcaaauau

SEQ ID NO: 35461 - RNA, 21 nt, Artificial Sequence
  Marburg virus siRNA sense strand
cuaacacacugggcaaauaug

SEQ ID NO: 35462 - RNA, 21 nt, Artificial Sequence
  Marburg virus siRNA sense strand
uaacacacugggcaaauaugc

SEQ ID NO: 35463 - RNA, 21 nt, Artificial Sequence
  Marburg virus siRNA sense strand
aacacacugggcaaauaugcu

SEQ ID NO: 35464 - RNA, 21 nt, Artificial Sequence
  Marburg virus siRNA sense strand
acacacugggcaaauaugcug

SEQ ID NO: 35465 - RNA, 21 nt, Artificial Sequence
  Marburg virus siRNA sense strand
cacacugggcaaauaugcugg

SEQ ID NO: 35466 - RNA, 21 nt, Artificial Sequence
  Marburg virus siRNA sense strand
acacugggcaaauaugcuggg

SEQ ID NO: 35467 - RNA, 21 nt, Artificial Sequence
  Marburg virus siRNA sense strand
cacugggcaaauaugcugggg

SEQ ID NO: 35468 - RNA, 21 nt, Artificial Sequence
  Marburg virus siRNA sense strand
acugggcaaauaugcuggggg

SEQ ID NO: 35469 - RNA, 21 nt, Artificial Sequence
  Marburg virus siRNA sense strand
cugggcaaauaugcugggggg

SEQ ID NO: 35470 - RNA, 21 nt, Artificial Sequence
  Marburg virus siRNA sense strand
ugggcaaauaugcuggggggg

SEQ ID NO: 35471 - RNA, 21 nt, Artificial Sequence
  Marburg virus siRNA sense strand
gggcaaauaugcugggggggg

SEQ ID NO: 35472 - RNA, 21 nt, Artificial Sequence
  Marburg virus siRNA sense strand
ggcaaauaugcuggggggggu

SEQ ID NO: 35473 - RNA, 21 nt, Artificial Sequence
  Marburg virus siRNA sense strand
gcaaauaugcugggggggguc

SEQ ID NO: 35474 - RNA, 21 nt, Artificial Sequence
  Marburg virus siRNA sense strand
caaauaugcugggggggguca

SEQ ID NO: 35475 - RNA, 21 nt, Artificial Sequence
  Marburg virus siRNA sense strand
aaauaugcuggggggggucaa

SEQ ID NO: 35476 - RNA, 21 nt, Artificial Sequence
  Marburg virus siRNA sense strand
aauaugcuggggggggucaag

SEQ ID NO: 35477 - RNA, 21 nt, Artificial Sequence
  Marburg virus siRNA sense strand
auaugcuggggggggucaagc

SEQ ID NO: 35478 - RNA, 21 nt, Artificial Sequence
  Marburg virus siRNA sense strand
uaugcuggggggggucaagcu

SEQ ID NO: 35479 - RNA, 21 nt, Artificial Sequence
  Marburg virus siRNA sense strand
augcuggggggggucaagcug

SEQ ID NO: 35480 - RNA, 21 nt, Artificial Sequence
  Marburg virus siRNA sense strand
ugcuggggggggucaagcugc

SEQ ID NO: 35481 - RNA, 21 nt, Artificial Sequence
  Marburg virus siRNA sense strand
gcuggggggggucaagcugcu

SEQ ID NO: 35482 - RNA, 21 nt, Artificial Sequence
  Marburg virus siRNA sense strand
cuggggggggucaagcugcug

SEQ ID NO: 35483 - RNA, 21 nt, Artificial Sequence
  Marburg virus siRNA sense strand
uggggggggucaagcugcugu

SEQ ID NO: 35484 - RNA, 21 nt, Artificial Sequence
  Marburg virus siRNA sense strand
ggggggggucaagcugcuguu

SEQ ID NO: 35485 - RNA, 21 nt, Artificial Sequence
  Marburg virus siRNA sense strand
gggggggucaagcugcuguug

SEQ ID NO: 35486 - RNA, 21 nt, Artificial Sequence
  Marburg virus siRNA sense strand
ggggggucaagcugcuguuga

SEQ ID NO: 35487 - RNA, 21 nt, Artificial Sequence
  Marburg virus siRNA sense strand
gggggucaagcugcuguugau

SEQ ID NO: 35488 - RNA, 21 nt, Artificial Sequence
  Marburg virus siRNA sense strand
ggggucaagcugcuguugaua

SEQ ID NO: 35489 - RNA, 21 nt, Artificial Sequence
  Marburg virus siRNA sense strand
gggucaagcugcuguugauag

SEQ ID NO: 35490 - RNA, 21 nt, Artificial Sequence
  Marburg virus siRNA sense strand
ggucaagcugcuguugauagu

SEQ ID NO: 35491 - RNA, 21 nt, Artificial Sequence
  Marburg virus siRNA sense strand
gucaagcugcuguugauagua

SEQ ID NO: 35492 - RNA, 21 nt, Artificial Sequence
  Marburg virus siRNA sense strand
ucaagcugcuguugauaguaa

SEQ ID NO: 35493 - RNA, 21 nt, Artificial Sequence
  Marburg virus siRNA sense strand
caagcugcuguugauaguaau

SEQ ID NO: 35494 - RNA, 21 nt, Artificial Sequence
  Marburg virus siRNA sense strand
aagcugcuguugauaguaaua

SEQ ID NO: 35495 - RNA, 21 nt, Artificial Sequence
  Marburg virus siRNA sense strand
agcugcuguugauaguaauau

SEQ ID NO: 35496 - RNA, 21 nt, Artificial Sequence
  Marburg virus siRNA sense strand
gcugcuguugauaguaauaua

SEQ ID NO: 35497 - RNA, 21 nt, Artificial Sequence
  Marburg virus siRNA sense strand
cugcuguugauaguaauauaa

SEQ ID NO: 35498 - RNA, 21 nt, Artificial Sequence
  Marburg virus siRNA sense strand
ugcuguugauaguaauauaau

SEQ ID NO: 35499 - RNA, 21 nt, Artificial Sequence
  Marburg virus siRNA sense strand
gcuguugauaguaauauaauc

SEQ ID NO: 35500 - RNA, 21 nt, Artificial Sequence
  Marburg virus siRNA sense strand
cuguugauaguaauauaaucu

SEQ ID NO: 35501 - RNA, 21 nt, Artificial Sequence
  Marburg virus siRNA sense strand
uguugauaguaauauaaucuu

SEQ ID NO: 35502 - RNA, 21 nt, Artificial Sequence
  Marburg virus siRNA sense strand
guugauaguaauauaaucuuc

SEQ ID NO: 35503 - RNA, 21 nt, Artificial Sequence
  Marburg virus siRNA sense strand
uugauaguaauauaaucuucc

SEQ ID NO: 35504 - RNA, 21 nt, Artificial Sequence
  Marburg virus siRNA sense strand
ugauaguaauauaaucuucca

SEQ ID NO: 35505 - RNA, 21 nt, Artificial Sequence
  Marburg virus siRNA sense strand
gauaguaauauaaucuuccaa

SEQ ID NO: 35506 - RNA, 21 nt, Artificial Sequence
  Marburg virus siRNA sense strand
auaguaauauaaucuuccaaa

SEQ ID NO: 35507 - RNA, 21 nt, Artificial Sequence
  Marburg virus siRNA sense strand
uaguaauauaaucuuccaaaa

SEQ ID NO: 35508 - RNA, 21 nt, Artificial Sequence
  Marburg virus siRNA sense strand
aguaauauaaucuuccaaaau

SEQ ID NO: 35509 - RNA, 21 nt, Artificial Sequence
  Marburg virus siRNA sense strand
guaauauaaucuuccaaaaua

SEQ ID NO: 35510 - RNA, 21 nt, Artificial Sequence
  Marburg virus siRNA sense strand
uaauauaaucuuccaaaauac

SEQ ID NO: 35511 - RNA, 21 nt, Artificial Sequence
  Marburg virus siRNA sense strand
aauauaaucuuccaaaauacu

SEQ ID NO: 35512 - RNA, 21 nt, Artificial Sequence
  Marburg virus siRNA sense strand
auauaaucuuccaaaauacua

SEQ ID NO: 35513 - RNA, 21 nt, Artificial Sequence
  Marburg virus siRNA sense strand
uauaaucuuccaaaauacuau

SEQ ID NO: 35514 - RNA, 21 nt, Artificial Sequence
  Marburg virus siRNA sense strand
auaaucuuccaaaauacuauc

SEQ ID NO: 35515 - RNA, 21 nt, Artificial Sequence
  Marburg virus siRNA sense strand
uaaucuuccaaaauacuauca

SEQ ID NO: 35516 - RNA, 21 nt, Artificial Sequence
  Marburg virus siRNA sense strand
aaucuuccaaaauacuaucaa

SEQ ID NO: 35517 - RNA, 21 nt, Artificial Sequence
  Marburg virus siRNA sense strand
aucuuccaaaauacuaucaau

SEQ ID NO: 35518 - RNA, 21 nt, Artificial Sequence
  Marburg virus siRNA sense strand
ucuuccaaaauacuaucaauu

SEQ ID NO: 35519 - RNA, 21 nt, Artificial Sequence
  Marburg virus siRNA sense strand
cuuccaaaauacuaucaauuu

SEQ ID NO: 35520 - RNA, 21 nt, Artificial Sequence
  Marburg virus siRNA sense strand
uuccaaaauacuaucaauuua

SEQ ID NO: 35521 - RNA, 21 nt, Artificial Sequence
  Marburg virus siRNA sense strand
uccaaaauacuaucaauuuag

SEQ ID NO: 35522 - RNA, 21 nt, Artificial Sequence
  Marburg virus siRNA sense strand
ccaaaauacuaucaauuuagg

SEQ ID NO: 35523 - RNA, 21 nt, Artificial Sequence
  Marburg virus siRNA sense strand
caaaauacuaucaauuuagga

SEQ ID NO: 35524 - RNA, 21 nt, Artificial Sequence
  Marburg virus siRNA sense strand
aaaauacuaucaauuuaggag

SEQ ID NO: 35525 - RNA, 21 nt, Artificial Sequence
  Marburg virus siRNA sense strand
aaauacuaucaauuuaggagu

SEQ ID NO: 35526 - RNA, 21 nt, Artificial Sequence
  Marburg virus siRNA sense strand
aauacuaucaauuuaggagug

SEQ ID NO: 35527 - RNA, 21 nt, Artificial Sequence
  Marburg virus siRNA sense strand
auacuaucaauuuaggagugg

SEQ ID NO: 35528 - RNA, 21 nt, Artificial Sequence
  Marburg virus siRNA sense strand
uacuaucaauuuaggaguggc

SEQ ID NO: 35529 - RNA, 21 nt, Artificial Sequence
  Marburg virus siRNA sense strand
acuaucaauuuaggaguggca

SEQ ID NO: 35530 - RNA, 21 nt, Artificial Sequence
  Marburg virus siRNA sense strand
cuaucaauuuaggaguggcag

SEQ ID NO: 35531 - RNA, 21 nt, Artificial Sequence
  Marburg virus siRNA sense strand
uaucaauuuaggaguggcagu

SEQ ID NO: 35532 - RNA, 21 nt, Artificial Sequence
  Marburg virus siRNA sense strand
aucaauuuaggaguggcaguu

SEQ ID NO: 35533 - RNA, 21 nt, Artificial Sequence
  Marburg virus siRNA sense strand
ucaauuuaggaguggcaguuu

SEQ ID NO: 35534 - RNA, 21 nt, Artificial Sequence
  Marburg virus siRNA sense strand
caauuuaggaguggcaguuuu

SEQ ID NO: 35535 - RNA, 21 nt, Artificial Sequence
  Marburg virus siRNA sense strand
aauuuaggaguggcaguuuua

SEQ ID NO: 35536 - RNA, 21 nt, Artificial Sequence
  Marburg virus siRNA sense strand
auuuaggaguggcaguuuuag

SEQ ID NO: 35537 - RNA, 21 nt, Artificial Sequence
  Marburg virus siRNA sense strand
uuuaggaguggcaguuuuaga

SEQ ID NO: 35538 - RNA, 21 nt, Artificial Sequence
  Marburg virus siRNA sense strand
uuaggaguggcaguuuuagau

SEQ ID NO: 35539 - RNA, 21 nt, Artificial Sequence
  Marburg virus siRNA sense strand
uaggaguggcaguuuuagaua

SEQ ID NO: 35540 - RNA, 21 nt, Artificial Sequence
  Marburg virus siRNA sense strand
aggaguggcaguuuuagauau

SEQ ID NO: 35541 - RNA, 21 nt, Artificial Sequence
  Marburg virus siRNA sense strand
ggaguggcaguuuuagauauu

SEQ ID NO: 35542 - RNA, 21 nt, Artificial Sequence
  Marburg virus siRNA sense strand
gaguggcaguuuuagauauug

SEQ ID NO: 35543 - RNA, 21 nt, Artificial Sequence
  Marburg virus siRNA sense strand
aguggcaguuuuagauauugc

SEQ ID NO: 35544 - RNA, 21 nt, Artificial Sequence
  Marburg virus siRNA sense strand
guggcaguuuuagauauugca

SEQ ID NO: 35545 - RNA, 21 nt, Artificial Sequence
  Marburg virus siRNA sense strand
uggcaguuuuagauauugcau

SEQ ID NO: 35546 - RNA, 21 nt, Artificial Sequence
  Marburg virus siRNA sense strand
ggcaguuuuagauauugcauu

SEQ ID NO: 35547 - RNA, 21 nt, Artificial Sequence
  Marburg virus siRNA sense strand
gcaguuuuagauauugcauua

SEQ ID NO: 35548 - RNA, 21 nt, Artificial Sequence
  Marburg virus siRNA sense strand
caguuuuagauauugcauuau

SEQ ID NO: 35549 - RNA, 21 nt, Artificial Sequence
  Marburg virus siRNA sense strand
aguuuuagauauugcauuauc

SEQ ID NO: 35550 - RNA, 21 nt, Artificial Sequence
  Marburg virus siRNA sense strand
guuuuagauauugcauuaucu

SEQ ID NO: 35551 - RNA, 21 nt, Artificial Sequence
  Marburg virus siRNA sense strand
uuuuagauauugcauuaucuc

SEQ ID NO: 35552 - RNA, 21 nt, Artificial Sequence
  Marburg virus siRNA sense strand
uuuagauauugcauuaucucu

SEQ ID NO: 35553 - RNA, 21 nt, Artificial Sequence
  Marburg virus siRNA sense strand
uuagauauugcauuaucucuu

SEQ ID NO: 35554 - RNA, 21 nt, Artificial Sequence
  Marburg virus siRNA sense strand
uagauauugcauuaucucuug

SEQ ID NO: 35555 - RNA, 21 nt, Artificial Sequence
  Marburg virus siRNA sense strand
agauauugcauuaucucuugc

SEQ ID NO: 35556 - RNA, 21 nt, Artificial Sequence
  Marburg virus siRNA sense strand
gauauugcauuaucucuugcu

SEQ ID NO: 35557 - RNA, 21 nt, Artificial Sequence
  Marburg virus siRNA sense strand
auauugcauuaucucuugcua

SEQ ID NO: 35558 - RNA, 21 nt, Artificial Sequence
  Marburg virus siRNA sense strand
uauugcauuaucucuugcuaa

SEQ ID NO: 35559 - RNA, 21 nt, Artificial Sequence
  Marburg virus siRNA sense strand
auugcauuaucucuugcuaaa

SEQ ID NO: 35560 - RNA, 21 nt, Artificial Sequence
  Marburg virus siRNA sense strand
uugcauuaucucuugcuaaau

SEQ ID NO: 35561 - RNA, 21 nt, Artificial Sequence
  Marburg virus siRNA sense strand
ugcauuaucucuugcuaaauu

SEQ ID NO: 35562 - RNA, 21 nt, Artificial Sequence
  Marburg virus siRNA sense strand
gcauuaucucuugcuaaauug

SEQ ID NO: 35563 - RNA, 21 nt, Artificial Sequence
  Marburg virus siRNA sense strand
cauuaucucuugcuaaauugu

SEQ ID NO: 35564 - RNA, 21 nt, Artificial Sequence
  Marburg virus siRNA sense strand
auuaucucuugcuaaauuguc

SEQ ID NO: 35565 - RNA, 21 nt, Artificial Sequence
  Marburg virus siRNA sense strand
uuaucucuugcuaaauugucg

SEQ ID NO: 35566 - RNA, 21 nt, Artificial Sequence
  Marburg virus siRNA sense strand
uaucucuugcuaaauugucgu

SEQ ID NO: 35567 - RNA, 21 nt, Artificial Sequence
  Marburg virus siRNA sense strand
aucucuugcuaaauugucguc

SEQ ID NO: 35568 - RNA, 21 nt, Artificial Sequence
  Marburg virus siRNA sense strand
ucucuugcuaaauugucguca

SEQ ID NO: 35569 - RNA, 21 nt, Artificial Sequence
  Marburg virus siRNA sense strand
cucuugcuaaauugucgucag

SEQ ID NO: 35570 - RNA, 21 nt, Artificial Sequence
  Marburg virus siRNA sense strand
ucuugcuaaauugucgucagc

SEQ ID NO: 35571 - RNA, 21 nt, Artificial Sequence
  Marburg virus siRNA sense strand
cuugcuaaauugucgucagca

SEQ ID NO: 35572 - RNA, 21 nt, Artificial Sequence
  Marburg virus siRNA sense strand
uugcuaaauugucgucagcau

SEQ ID NO: 35573 - RNA, 21 nt, Artificial Sequence
  Marburg virus siRNA sense strand
ugcuaaauugucgucagcauc

SEQ ID NO: 35574 - RNA, 21 nt, Artificial Sequence
  Marburg virus siRNA sense strand
gcuaaauugucgucagcauca

SEQ ID NO: 35575 - RNA, 21 nt, Artificial Sequence
  Marburg virus siRNA sense strand
cuaaauugucgucagcaucaa

SEQ ID NO: 35576 - RNA, 21 nt, Artificial Sequence
  Marburg virus siRNA sense strand
uaaauugucgucagcaucaaa

SEQ ID NO: 35577 - RNA, 21 nt, Artificial Sequence
  Marburg virus siRNA sense strand
aaauugucgucagcaucaaau

SEQ ID NO: 35578 - RNA, 21 nt, Artificial Sequence
  Marburg virus siRNA sense strand
aauugucgucagcaucaaaug

SEQ ID NO: 35579 - RNA, 21 nt, Artificial Sequence
  Marburg virus siRNA sense strand
auugucgucagcaucaaaugu

SEQ ID NO: 35580 - RNA, 21 nt, Artificial Sequence
  Marburg virus siRNA sense strand
uugucgucagcaucaaauguc

SEQ ID NO: 35581 - RNA, 21 nt, Artificial Sequence
  Marburg virus siRNA sense strand
ugucgucagcaucaaauguca

SEQ ID NO: 35582 - RNA, 21 nt, Artificial Sequence
  Marburg virus siRNA sense strand
gucgucagcaucaaaugucac

SEQ ID NO: 35583 - RNA, 21 nt, Artificial Sequence
  Marburg virus siRNA sense strand
ucgucagcaucaaaugucacu

SEQ ID NO: 35584 - RNA, 21 nt, Artificial Sequence
  Marburg virus siRNA sense strand
cgucagcaucaaaugucacuu

SEQ ID NO: 35585 - RNA, 21 nt, Artificial Sequence
  Marburg virus siRNA sense strand
gucagcaucaaaugucacuuu

SEQ ID NO: 35586 - RNA, 21 nt, Artificial Sequence
  Marburg virus siRNA sense strand
ucagcaucaaaugucacuuuc

SEQ ID NO: 35587 - RNA, 21 nt, Artificial Sequence
  Marburg virus siRNA sense strand
cagcaucaaaugucacuuucc

SEQ ID NO: 35588 - RNA, 21 nt, Artificial Sequence
  Marburg virus siRNA sense strand
agcaucaaaugucacuuuccg

SEQ ID NO: 35589 - RNA, 21 nt, Artificial Sequence
  Marburg virus siRNA sense strand
gcaucaaaugucacuuuccgu

SEQ ID NO: 35590 - RNA, 21 nt, Artificial Sequence
  Marburg virus siRNA sense strand
caucaaaugucacuuuccguu

SEQ ID NO: 35591 - RNA, 21 nt, Artificial Sequence
  Marburg virus siRNA sense strand
aucaaaugucacuuuccguuu

SEQ ID NO: 35592 - RNA, 21 nt, Artificial Sequence
  Marburg virus siRNA sense strand
ucaaaugucacuuuccguuug

SEQ ID NO: 35593 - RNA, 21 nt, Artificial Sequence
  Marburg virus siRNA sense strand
caaaugucacuuuccguuuga

SEQ ID NO: 35594 - RNA, 21 nt, Artificial Sequence
  Marburg virus siRNA sense strand
aaaugucacuuuccguuugau

SEQ ID NO: 35595 - RNA, 21 nt, Artificial Sequence
  Marburg virus siRNA sense strand
aaugucacuuuccguuugaug

SEQ ID NO: 35596 - RNA, 21 nt, Artificial Sequence
  Marburg virus siRNA sense strand
augucacuuuccguuugaugu

SEQ ID NO: 35597 - RNA, 21 nt, Artificial Sequence
  Marburg virus siRNA sense strand
ugucacuuuccguuugauguu

SEQ ID NO: 35598 - RNA, 21 nt, Artificial Sequence
  Marburg virus siRNA sense strand
gucacuuuccguuugauguua

SEQ ID NO: 35599 - RNA, 21 nt, Artificial Sequence
  Marburg virus siRNA sense strand
ucacuuuccguuugauguuaa

SEQ ID NO: 35600 - RNA, 21 nt, Artificial Sequence
  Marburg virus siRNA sense strand
cacuuuccguuugauguuaaa

SEQ ID NO: 35601 - RNA, 21 nt, Artificial Sequence
  Marburg virus siRNA sense strand
acuuuccguuugauguuaaau

SEQ ID NO: 35602 - RNA, 21 nt, Artificial Sequence
  Marburg virus siRNA sense strand
cuuuccguuugauguuaaaua

SEQ ID NO: 35603 - RNA, 21 nt, Artificial Sequence
  Marburg virus siRNA sense strand
uuuccguuugauguuaaauaa

SEQ ID NO: 35604 - RNA, 21 nt, Artificial Sequence
  Marburg virus siRNA sense strand
uuccguuugauguuaaauaag

SEQ ID NO: 35605 - RNA, 21 nt, Artificial Sequence
  Marburg virus siRNA sense strand
uccguuugauguuaaauaagu

SEQ ID NO: 35606 - RNA, 21 nt, Artificial Sequence
  Marburg virus siRNA sense strand
ccguuugauguuaaauaagug

SEQ ID NO: 35607 - RNA, 21 nt, Artificial Sequence
  Marburg virus siRNA sense strand
cguuugauguuaaauaagugc

SEQ ID NO: 35608 - RNA, 21 nt, Artificial Sequence
  Marburg virus siRNA sense strand
guuugauguuaaauaagugcu

SEQ ID NO: 35609 - RNA, 21 nt, Artificial Sequence
  Marburg virus siRNA sense strand
uuugauguuaaauaagugcug

SEQ ID NO: 35610 - RNA, 21 nt, Artificial Sequence
  Marburg virus siRNA sense strand
uugauguuaaauaagugcugc

SEQ ID NO: 35611 - RNA, 21 nt, Artificial Sequence
  Marburg virus siRNA sense strand
ugauguuaaauaagugcugca

SEQ ID NO: 35612 - RNA, 21 nt, Artificial Sequence
  Marburg virus siRNA sense strand
gauguuaaauaagugcugcac

SEQ ID NO: 35613 - RNA, 21 nt, Artificial Sequence
  Marburg virus siRNA sense strand
auguuaaauaagugcugcacg

SEQ ID NO: 35614 - RNA, 21 nt, Artificial Sequence
  Marburg virus siRNA sense strand
uguuaaauaagugcugcacgc

SEQ ID NO: 35615 - RNA, 21 nt, Artificial Sequence
  Marburg virus siRNA sense strand
guuaaauaagugcugcacgcg

SEQ ID NO: 35616 - RNA, 21 nt, Artificial Sequence
  Marburg virus siRNA sense strand
uuaaauaagugcugcacgcgg

SEQ ID NO: 35617 - RNA, 21 nt, Artificial Sequence
  Marburg virus siRNA sense strand
uaaauaagugcugcacgcggc

SEQ ID NO: 35618 - RNA, 21 nt, Artificial Sequence
  Marburg virus siRNA sense strand
aaauaagugcugcacgcggca

SEQ ID NO: 35619 - RNA, 21 nt, Artificial Sequence
  Marburg virus siRNA sense strand
aauaagugcugcacgcggcau

SEQ ID NO: 35620 - RNA, 21 nt, Artificial Sequence
  Marburg virus siRNA sense strand
auaagugcugcacgcggcaug

SEQ ID NO: 35621 - RNA, 21 nt, Artificial Sequence
  Marburg virus siRNA sense strand
uaagugcugcacgcggcaugu

SEQ ID NO: 35622 - RNA, 21 nt, Artificial Sequence
  Marburg virus siRNA sense strand
aagugcugcacgcggcaugug

SEQ ID NO: 35623 - RNA, 21 nt, Artificial Sequence
  Marburg virus siRNA sense strand
agugcugcacgcggcaugugc

SEQ ID NO: 35624 - RNA, 21 nt, Artificial Sequence
  Marburg virus siRNA sense strand
gugcugcacgcggcaugugcc

SEQ ID NO: 35625 - RNA, 21 nt, Artificial Sequence
  Marburg virus siRNA sense strand
ugcugcacgcggcaugugcca

SEQ ID NO: 35626 - RNA, 21 nt, Artificial Sequence
  Marburg virus siRNA sense strand
gcugcacgcggcaugugccau

SEQ ID NO: 35627 - RNA, 21 nt, Artificial Sequence
  Marburg virus siRNA sense strand
cugcacgcggcaugugccauc

SEQ ID NO: 35628 - RNA, 21 nt, Artificial Sequence
  Marburg virus siRNA sense strand
ugcacgcggcaugugccaucu

SEQ ID NO: 35629 - RNA, 21 nt, Artificial Sequence
  Marburg virus siRNA sense strand
gcacgcggcaugugccaucug

SEQ ID NO: 35630 - RNA, 21 nt, Artificial Sequence
  Marburg virus siRNA sense strand
cacgcggcaugugccaucuga

SEQ ID NO: 35631 - RNA, 21 nt, Artificial Sequence
  Marburg virus siRNA sense strand
acgcggcaugugccaucugaa

SEQ ID NO: 35632 - RNA, 21 nt, Artificial Sequence
  Marburg virus siRNA sense strand
cgcggcaugugccaucugaau

SEQ ID NO: 35633 - RNA, 21 nt, Artificial Sequence
  Marburg virus siRNA sense strand
gcggcaugugccaucugaaua

SEQ ID NO: 35634 - RNA, 21 nt, Artificial Sequence
  Marburg virus siRNA sense strand
cggcaugugccaucugaauac

SEQ ID NO: 35635 - RNA, 21 nt, Artificial Sequence
  Marburg virus siRNA sense strand
ggcaugugccaucugaauacc

SEQ ID NO: 35636 - RNA, 21 nt, Artificial Sequence
  Marburg virus siRNA sense strand
gcaugugccaucugaauaccu

SEQ ID NO: 35637 - RNA, 21 nt, Artificial Sequence
  Marburg virus siRNA sense strand
caugugccaucugaauaccua

SEQ ID NO: 35638 - RNA, 21 nt, Artificial Sequence
  Marburg virus siRNA sense strand
augugccaucugaauaccuau

SEQ ID NO: 35639 - RNA, 21 nt, Artificial Sequence
  Marburg virus siRNA sense strand
ugugccaucugaauaccuauu

SEQ ID NO: 35640 - RNA, 21 nt, Artificial Sequence
  Marburg virus siRNA sense strand
gugccaucugaauaccuauuu

SEQ ID NO: 35641 - RNA, 21 nt, Artificial Sequence
  Marburg virus siRNA sense strand
ugccaucugaauaccuauuuu

SEQ ID NO: 35642 - RNA, 21 nt, Artificial Sequence
  Marburg virus siRNA sense strand
gccaucugaauaccuauuuuu

SEQ ID NO: 35643 - RNA, 21 nt, Artificial Sequence
  Marburg virus siRNA sense strand
ccaucugaauaccuauuuuuu

SEQ ID NO: 35644 - RNA, 21 nt, Artificial Sequence
  Marburg virus siRNA sense strand
caucugaauaccuauuuuuug

SEQ ID NO: 35645 - RNA, 21 nt, Artificial Sequence
  Marburg virus siRNA sense strand
aucugaauaccuauuuuuuga

SEQ ID NO: 35646 - RNA, 21 nt, Artificial Sequence
  Marburg virus siRNA sense strand
ucugaauaccuauuuuuugau

SEQ ID NO: 35647 - RNA, 21 nt, Artificial Sequence
  Marburg virus siRNA sense strand
cugaauaccuauuuuuugaua

SEQ ID NO: 35648 - RNA, 21 nt, Artificial Sequence
  Marburg virus siRNA sense strand
ugaauaccuauuuuuugauaa

SEQ ID NO: 35649 - RNA, 21 nt, Artificial Sequence
  Marburg virus siRNA sense strand
gaauaccuauuuuuugauaaa

SEQ ID NO: 35650 - RNA, 21 nt, Artificial Sequence
  Marburg virus siRNA sense strand
aauaccuauuuuuugauaaac

SEQ ID NO: 35651 - RNA, 21 nt, Artificial Sequence
  Marburg virus siRNA sense strand
auaccuauuuuuugauaaacc

SEQ ID NO: 35652 - RNA, 21 nt, Artificial Sequence
  Marburg virus siRNA sense strand
uaccuauuuuuugauaaaccu

SEQ ID NO: 35653 - RNA, 21 nt, Artificial Sequence
  Marburg virus siRNA sense strand
accuauuuuuugauaaaccuu

SEQ ID NO: 35654 - RNA, 21 nt, Artificial Sequence
  Marburg virus siRNA sense strand
ccuauuuuuugauaaaccuuu

SEQ ID NO: 35655 - RNA, 21 nt, Artificial Sequence
  Marburg virus siRNA sense strand
cuauuuuuugauaaaccuuua

SEQ ID NO: 35656 - RNA, 21 nt, Artificial Sequence
  Marburg virus siRNA sense strand
uauuuuuugauaaaccuuuag

SEQ ID NO: 35657 - RNA, 21 nt, Artificial Sequence
  Marburg virus siRNA sense strand
auuuuuugauaaaccuuuaga

SEQ ID NO: 35658 - RNA, 21 nt, Artificial Sequence
  Marburg virus siRNA sense strand
uuuuuugauaaaccuuuagau

SEQ ID NO: 35659 - RNA, 21 nt, Artificial Sequence
  Marburg virus siRNA sense strand
uuuuugauaaaccuuuagaug

SEQ ID NO: 35660 - RNA, 21 nt, Artificial Sequence
  Marburg virus siRNA sense strand
uuuugauaaaccuuuagaugu

SEQ ID NO: 35661 - RNA, 21 nt, Artificial Sequence
  Marburg virus siRNA sense strand
uuugauaaaccuuuagaugug

SEQ ID NO: 35662 - RNA, 21 nt, Artificial Sequence
  Marburg virus siRNA sense strand
uugauaaaccuuuagaugugg

SEQ ID NO: 35663 - RNA, 21 nt, Artificial Sequence
  Marburg virus siRNA sense strand
ugauaaaccuuuagaugugga

SEQ ID NO: 35664 - RNA, 21 nt, Artificial Sequence
  Marburg virus siRNA sense strand
gauaaaccuuuagauguggau

SEQ ID NO: 35665 - RNA, 21 nt, Artificial Sequence
  Marburg virus siRNA sense strand
auaaaccuuuagauguggauu

SEQ ID NO: 35666 - RNA, 21 nt, Artificial Sequence
  Marburg virus siRNA sense strand
uaaaccuuuagauguggauuu

SEQ ID NO: 35667 - RNA, 21 nt, Artificial Sequence
  Marburg virus siRNA sense strand
aaaccuuuagauguggauuug

SEQ ID NO: 35668 - RNA, 21 nt, Artificial Sequence
  Marburg virus siRNA sense strand
aaccuuuagauguggauuuga

SEQ ID NO: 35669 - RNA, 21 nt, Artificial Sequence
  Marburg virus siRNA sense strand
accuuuagauguggauuugaa

SEQ ID NO: 35670 - RNA, 21 nt, Artificial Sequence
  Marburg virus siRNA sense strand
ccuuuagauguggauuugaac

SEQ ID NO: 35671 - RNA, 21 nt, Artificial Sequence
  Marburg virus siRNA sense strand
cuuuagauguggauuugaaca

SEQ ID NO: 35672 - RNA, 21 nt, Artificial Sequence
  Marburg virus siRNA sense strand
uuuagauguggauuugaacaa

SEQ ID NO: 35673 - RNA, 21 nt, Artificial Sequence
  Marburg virus siRNA sense strand
uuagauguggauuugaacaag

SEQ ID NO: 35674 - RNA, 21 nt, Artificial Sequence
  Marburg virus siRNA sense strand
uagauguggauuugaacaagu

SEQ ID NO: 35675 - RNA, 21 nt, Artificial Sequence
  Marburg virus siRNA sense strand
agauguggauuugaacaagua

SEQ ID NO: 35676 - RNA, 21 nt, Artificial Sequence
  Marburg virus siRNA sense strand
gauguggauuugaacaaguau

SEQ ID NO: 35677 - RNA, 21 nt, Artificial Sequence
  Marburg virus siRNA sense strand
auguggauuugaacaaguaua

SEQ ID NO: 35678 - RNA, 21 nt, Artificial Sequence
  Marburg virus siRNA sense strand
uguggauuugaacaaguauau

SEQ ID NO: 35679 - RNA, 21 nt, Artificial Sequence
  Marburg virus siRNA sense strand
guggauuugaacaaguauaug

SEQ ID NO: 35680 - RNA, 21 nt, Artificial Sequence
  Marburg virus siRNA sense strand
uggauuugaacaaguauaugg

SEQ ID NO: 35681 - RNA, 21 nt, Artificial Sequence
  Marburg virus siRNA sense strand
ggauuugaacaaguauaugga

SEQ ID NO: 35682 - RNA, 21 nt, Artificial Sequence
  Marburg virus siRNA sense strand
gauuugaacaaguauauggac

SEQ ID NO: 35683 - RNA, 21 nt, Artificial Sequence
  Marburg virus siRNA sense strand
auuugaacaaguauauggaca

SEQ ID NO: 35684 - RNA, 21 nt, Artificial Sequence
  Marburg virus siRNA sense strand
uuugaacaaguauauggacaa

SEQ ID NO: 35685 - RNA, 21 nt, Artificial Sequence
  Marburg virus siRNA sense strand
uugaacaaguauauggacaau

SEQ ID NO: 35686 - RNA, 21 nt, Artificial Sequence
  Marburg virus siRNA sense strand
ugaacaaguauauggacaaug

SEQ ID NO: 35687 - RNA, 21 nt, Artificial Sequence
  Marburg virus siRNA sense strand
gaacaaguauauggacaauga

SEQ ID NO: 35688 - RNA, 21 nt, Artificial Sequence
  Marburg virus siRNA sense strand
aacaaguauauggacaaugag

SEQ ID NO: 35689 - RNA, 21 nt, Artificial Sequence
  Marburg virus siRNA sense strand
acaaguauauggacaaugagu

SEQ ID NO: 35690 - RNA, 21 nt, Artificial Sequence
  Marburg virus siRNA sense strand
caaguauauggacaaugaguu

SEQ ID NO: 35691 - RNA, 21 nt, Artificial Sequence
  Marburg virus siRNA sense strand
aaguauauggacaaugaguua

SEQ ID NO: 35692 - RNA, 21 nt, Artificial Sequence
  Marburg virus siRNA sense strand
aguauauggacaaugaguuag

SEQ ID NO: 35693 - RNA, 21 nt, Artificial Sequence
  Marburg virus siRNA sense strand
guauauggacaaugaguuagu

SEQ ID NO: 35694 - RNA, 21 nt, Artificial Sequence
  Marburg virus siRNA sense strand
uauauggacaaugaguuaguu

SEQ ID NO: 35695 - RNA, 21 nt, Artificial Sequence
  Marburg virus siRNA sense strand
auauggacaaugaguuaguuu

SEQ ID NO: 35696 - RNA, 21 nt, Artificial Sequence
  Marburg virus siRNA sense strand
uauggacaaugaguuaguuua

SEQ ID NO: 35697 - RNA, 21 nt, Artificial Sequence
  Marburg virus siRNA sense strand
auggacaaugaguuaguuuau

SEQ ID NO: 35698 - RNA, 21 nt, Artificial Sequence
  Marburg virus siRNA sense strand
uggacaaugaguuaguuuaug

SEQ ID NO: 35699 - RNA, 21 nt, Artificial Sequence
  Marburg virus siRNA sense strand
ggacaaugaguuaguuuauga

SEQ ID NO: 35700 - RNA, 21 nt, Artificial Sequence
  Marburg virus siRNA sense strand
gacaaugaguuaguuuaugac

SEQ ID NO: 35701 - RNA, 21 nt, Artificial Sequence
  Marburg virus siRNA sense strand
acaaugaguuaguuuaugaca

SEQ ID NO: 35702 - RNA, 21 nt, Artificial Sequence
  Marburg virus siRNA sense strand
caaugaguuaguuuaugacaa

SEQ ID NO: 35703 - RNA, 21 nt, Artificial Sequence
  Marburg virus siRNA sense strand
aaugaguuaguuuaugacaau

SEQ ID NO: 35704 - RNA, 21 nt, Artificial Sequence
  Marburg virus siRNA sense strand
augaguuaguuuaugacaaug

SEQ ID NO: 35705 - RNA, 21 nt, Artificial Sequence
  Marburg virus siRNA sense strand
ugaguuaguuuaugacaauga

SEQ ID NO: 35706 - RNA, 21 nt, Artificial Sequence
  Marburg virus siRNA sense strand
gaguuaguuuaugacaaugac

SEQ ID NO: 35707 - RNA, 21 nt, Artificial Sequence
  Marburg virus siRNA sense strand
aguuaguuuaugacaaugacc

SEQ ID NO: 35708 - RNA, 21 nt, Artificial Sequence
  Marburg virus siRNA sense strand
guuaguuuaugacaaugaccc

SEQ ID NO: 35709 - RNA, 21 nt, Artificial Sequence
  Marburg virus siRNA sense strand
uuaguuuaugacaaugacccu

SEQ ID NO: 35710 - RNA, 21 nt, Artificial Sequence
  Marburg virus siRNA sense strand
uaguuuaugacaaugacccuc

SEQ ID NO: 35711 - RNA, 21 nt, Artificial Sequence
  Marburg virus siRNA sense strand
aguuuaugacaaugacccucu

SEQ ID NO: 35712 - RNA, 21 nt, Artificial Sequence
  Marburg virus siRNA sense strand
guuuaugacaaugacccucuu

SEQ ID NO: 35713 - RNA, 21 nt, Artificial Sequence
  Marburg virus siRNA sense strand
uuuaugacaaugacccucuuu

SEQ ID NO: 35714 - RNA, 21 nt, Artificial Sequence
  Marburg virus siRNA sense strand
uuaugacaaugacccucuuug

SEQ ID NO: 35715 - RNA, 21 nt, Artificial Sequence
  Marburg virus siRNA sense strand
uaugacaaugacccucuuugc

SEQ ID NO: 35716 - RNA, 21 nt, Artificial Sequence
  Marburg virus siRNA sense strand
augacaaugacccucuuugca

SEQ ID NO: 35717 - RNA, 21 nt, Artificial Sequence
  Marburg virus siRNA sense strand
ugacaaugacccucuuugcag

SEQ ID NO: 35718 - RNA, 21 nt, Artificial Sequence
  Marburg virus siRNA sense strand
gacaaugacccucuuugcagu

SEQ ID NO: 35719 - RNA, 21 nt, Artificial Sequence
  Marburg virus siRNA sense strand
acaaugacccucuuugcagug

SEQ ID NO: 35720 - RNA, 21 nt, Artificial Sequence
  Marburg virus siRNA sense strand
caaugacccucuuugcagugg

SEQ ID NO: 35721 - RNA, 21 nt, Artificial Sequence
  Marburg virus siRNA sense strand
aaugacccucuuugcaguggg

SEQ ID NO: 35722 - RNA, 21 nt, Artificial Sequence
  Marburg virus siRNA sense strand
augacccucuuugcaguggga

SEQ ID NO: 35723 - RNA, 21 nt, Artificial Sequence
  Marburg virus siRNA sense strand
ugacccucuuugcagugggau

SEQ ID NO: 35724 - RNA, 21 nt, Artificial Sequence
  Marburg virus siRNA sense strand
gacccucuuugcagugggauu

SEQ ID NO: 35725 - RNA, 21 nt, Artificial Sequence
  Marburg virus siRNA sense strand
acccucuuugcagugggauua

SEQ ID NO: 35726 - RNA, 21 nt, Artificial Sequence
  Marburg virus siRNA sense strand
cccucuuugcagugggauuaa

SEQ ID NO: 35727 - RNA, 21 nt, Artificial Sequence
  Marburg virus siRNA sense strand
ccucuuugcagugggauuaaa

SEQ ID NO: 35728 - RNA, 21 nt, Artificial Sequence
  Marburg virus siRNA sense strand
cucuuugcagugggauuaaag

SEQ ID NO: 35729 - RNA, 21 nt, Artificial Sequence
  Marburg virus siRNA sense strand
ucuuugcagugggauuaaagg

SEQ ID NO: 35730 - RNA, 21 nt, Artificial Sequence
  Marburg virus siRNA sense strand
cuuugcagugggauuaaaggg

SEQ ID NO: 35731 - RNA, 21 nt, Artificial Sequence
  Marburg virus siRNA sense strand
uuugcagugggauuaaaggga

SEQ ID NO: 35732 - RNA, 21 nt, Artificial Sequence
  Marburg virus siRNA sense strand
uugcagugggauuaaagggag

SEQ ID NO: 35733 - RNA, 21 nt, Artificial Sequence
  Marburg virus siRNA sense strand
ugcagugggauuaaagggaga

SEQ ID NO: 35734 - RNA, 21 nt, Artificial Sequence
  Marburg virus siRNA sense strand
gcagugggauuaaagggagau

SEQ ID NO: 35735 - RNA, 21 nt, Artificial Sequence
  Marburg virus siRNA sense strand
cagugggauuaaagggagauu

SEQ ID NO: 35736 - RNA, 21 nt, Artificial Sequence
  Marburg virus siRNA sense strand
agugggauuaaagggagauua

SEQ ID NO: 35737 - RNA, 21 nt, Artificial Sequence
  Marburg virus siRNA sense strand
gugggauuaaagggagauuag

SEQ ID NO: 35738 - RNA, 21 nt, Artificial Sequence
  Marburg virus siRNA sense strand
ugggauuaaagggagauuagg

SEQ ID NO: 35739 - RNA, 21 nt, Artificial Sequence
  Marburg virus siRNA sense strand
gggauuaaagggagauuaggc

SEQ ID NO: 35740 - RNA, 21 nt, Artificial Sequence
  Marburg virus siRNA sense strand
ggauuaaagggagauuaggca

SEQ ID NO: 35741 - RNA, 21 nt, Artificial Sequence
  Marburg virus siRNA sense strand
gauuaaagggagauuaggcag

SEQ ID NO: 35742 - RNA, 21 nt, Artificial Sequence
  Marburg virus siRNA sense strand
auuaaagggagauuaggcaga

SEQ ID NO: 35743 - RNA, 21 nt, Artificial Sequence
  Marburg virus siRNA sense strand
uuaaagggagauuaggcagag

SEQ ID NO: 35744 - RNA, 21 nt, Artificial Sequence
  Marburg virus siRNA sense strand
uaaagggagauuaggcagagu

SEQ ID NO: 35745 - RNA, 21 nt, Artificial Sequence
  Marburg virus siRNA sense strand
aaagggagauuaggcagagua

SEQ ID NO: 35746 - RNA, 21 nt, Artificial Sequence
  Marburg virus siRNA sense strand
aagggagauuaggcagaguau

SEQ ID NO: 35747 - RNA, 21 nt, Artificial Sequence
  Marburg virus siRNA sense strand
agggagauuaggcagaguauc

SEQ ID NO: 35748 - RNA, 21 nt, Artificial Sequence
  Marburg virus siRNA sense strand
gggagauuaggcagaguaucc

SEQ ID NO: 35749 - RNA, 21 nt, Artificial Sequence
  Marburg virus siRNA sense strand
ggagauuaggcagaguauccc

SEQ ID NO: 35750 - RNA, 21 nt, Artificial Sequence
  Marburg virus siRNA sense strand
gagauuaggcagaguaucccg

SEQ ID NO: 35751 - RNA, 21 nt, Artificial Sequence
  Marburg virus siRNA sense strand
agauuaggcagaguaucccga

SEQ ID NO: 35752 - RNA, 21 nt, Artificial Sequence
  Marburg virus siRNA sense strand
gauuaggcagaguaucccgau

SEQ ID NO: 35753 - RNA, 21 nt, Artificial Sequence
  Marburg virus siRNA sense strand
auuaggcagaguaucccgauc

SEQ ID NO: 35754 - RNA, 21 nt, Artificial Sequence
  Marburg virus siRNA sense strand
uuaggcagaguaucccgauca

SEQ ID NO: 35755 - RNA, 21 nt, Artificial Sequence
  Marburg virus siRNA sense strand
uaggcagaguaucccgaucaa

SEQ ID NO: 35756 - RNA, 21 nt, Artificial Sequence
  Marburg virus siRNA sense strand
aggcagaguaucccgaucaac

SEQ ID NO: 35757 - RNA, 21 nt, Artificial Sequence
  Marburg virus siRNA sense strand
ggcagaguaucccgaucaaca

SEQ ID NO: 35758 - RNA, 21 nt, Artificial Sequence
  Marburg virus siRNA sense strand
gcagaguaucccgaucaacac

SEQ ID NO: 35759 - RNA, 21 nt, Artificial Sequence
  Marburg virus siRNA sense strand
cagaguaucccgaucaacacu

SEQ ID NO: 35760 - RNA, 21 nt, Artificial Sequence
  Marburg virus siRNA sense strand
agaguaucccgaucaacacuc

SEQ ID NO: 35761 - RNA, 21 nt, Artificial Sequence
  Marburg virus siRNA sense strand
gaguaucccgaucaacacucu

SEQ ID NO: 35762 - RNA, 21 nt, Artificial Sequence
  Marburg virus siRNA sense strand
aguaucccgaucaacacucuc

SEQ ID NO: 35763 - RNA, 21 nt, Artificial Sequence
  Marburg virus siRNA sense strand
guaucccgaucaacacucucg

SEQ ID NO: 35764 - RNA, 21 nt, Artificial Sequence
  Marburg virus siRNA sense strand
uaucccgaucaacacucucgu

SEQ ID NO: 35765 - RNA, 21 nt, Artificial Sequence
  Marburg virus siRNA sense strand
aucccgaucaacacucucguu

SEQ ID NO: 35766 - RNA, 21 nt, Artificial Sequence
  Marburg virus siRNA sense strand
ucccgaucaacacucucguug

SEQ ID NO: 35767 - RNA, 21 nt, Artificial Sequence
  Marburg virus siRNA sense strand
cccgaucaacacucucguuga

SEQ ID NO: 35768 - RNA, 21 nt, Artificial Sequence
  Marburg virus siRNA sense strand
ccgaucaacacucucguugag

SEQ ID NO: 35769 - RNA, 21 nt, Artificial Sequence
  Marburg virus siRNA sense strand
cgaucaacacucucguugagu

SEQ ID NO: 35770 - RNA, 21 nt, Artificial Sequence
  Marburg virus siRNA sense strand
gaucaacacucucguugaguu

SEQ ID NO: 35771 - RNA, 21 nt, Artificial Sequence
  Marburg virus siRNA sense strand
aucaacacucucguugaguuu

SEQ ID NO: 35772 - RNA, 21 nt, Artificial Sequence
  Marburg virus siRNA sense strand
ucaacacucucguugaguuug

SEQ ID NO: 35773 - RNA, 21 nt, Artificial Sequence
  Marburg virus siRNA sense strand
caacacucucguugaguuuga

SEQ ID NO: 35774 - RNA, 21 nt, Artificial Sequence
  Marburg virus siRNA sense strand
aacacucucguugaguuugaa

SEQ ID NO: 35775 - RNA, 21 nt, Artificial Sequence
  Marburg virus siRNA sense strand
acacucucguugaguuugaau

SEQ ID NO: 35776 - RNA, 21 nt, Artificial Sequence
  Marburg virus siRNA sense strand
cacucucguugaguuugaaug

SEQ ID NO: 35777 - RNA, 21 nt, Artificial Sequence
  Marburg virus siRNA sense strand
acucucguugaguuugaaugu

SEQ ID NO: 35778 - RNA, 21 nt, Artificial Sequence
  Marburg virus siRNA sense strand
cucucguugaguuugaauguc

SEQ ID NO: 35779 - RNA, 21 nt, Artificial Sequence
  Marburg virus siRNA sense strand
ucucguugaguuugaauguca

SEQ ID NO: 35780 - RNA, 21 nt, Artificial Sequence
  Marburg virus siRNA sense strand
cucguugaguuugaaugucag

SEQ ID NO: 35781 - RNA, 21 nt, Artificial Sequence
  Marburg virus siRNA sense strand
ucguugaguuugaaugucagu

SEQ ID NO: 35782 - RNA, 21 nt, Artificial Sequence
  Marburg virus siRNA sense strand
cguugaguuugaaugucagug

SEQ ID NO: 35783 - RNA, 21 nt, Artificial Sequence
  Marburg virus siRNA sense strand
guugaguuugaaugucaguga

SEQ ID NO: 35784 - RNA, 21 nt, Artificial Sequence
  Marburg virus siRNA sense strand
uugaguuugaaugucagugac

SEQ ID NO: 35785 - RNA, 21 nt, Artificial Sequence
  Marburg virus siRNA sense strand
ugaguuugaaugucagugaca

SEQ ID NO: 35786 - RNA, 21 nt, Artificial Sequence
  Marburg virus siRNA sense strand
gaguuugaaugucagugacau

SEQ ID NO: 35787 - RNA, 21 nt, Artificial Sequence
  Marburg virus siRNA sense strand
aguuugaaugucagugacauu

SEQ ID NO: 35788 - RNA, 21 nt, Artificial Sequence
  Marburg virus siRNA sense strand
guuugaaugucagugacauug

SEQ ID NO: 35789 - RNA, 21 nt, Artificial Sequence
  Marburg virus siRNA sense strand
uuugaaugucagugacauugg

SEQ ID NO: 35790 - RNA, 21 nt, Artificial Sequence
  Marburg virus siRNA sense strand
uugaaugucagugacauuggu

SEQ ID NO: 35791 - RNA, 21 nt, Artificial Sequence
  Marburg virus siRNA sense strand
ugaaugucagugacauugguu

SEQ ID NO: 35792 - RNA, 21 nt, Artificial Sequence
  Marburg virus siRNA sense strand
gaaugucagugacauugguuc

SEQ ID NO: 35793 - RNA, 21 nt, Artificial Sequence
  Marburg virus siRNA sense strand
aaugucagugacauugguucu

SEQ ID NO: 35794 - RNA, 21 nt, Artificial Sequence
  Marburg virus siRNA sense strand
augucagugacauugguucuu

SEQ ID NO: 35795 - RNA, 21 nt, Artificial Sequence
  Marburg virus siRNA sense strand
ugucagugacauugguucuua

SEQ ID NO: 35796 - RNA, 21 nt, Artificial Sequence
  Marburg virus siRNA sense strand
gucagugacauugguucuuau

SEQ ID NO: 35797 - RNA, 21 nt, Artificial Sequence
  Marburg virus siRNA sense strand
ucagugacauugguucuuaug

SEQ ID NO: 35798 - RNA, 21 nt, Artificial Sequence
  Marburg virus siRNA sense strand
cagugacauugguucuuauga

SEQ ID NO: 35799 - RNA, 21 nt, Artificial Sequence
  Marburg virus siRNA sense strand
agugacauugguucuuaugac

SEQ ID NO: 35800 - RNA, 21 nt, Artificial Sequence
  Marburg virus siRNA sense strand
gugacauugguucuuaugacu

SEQ ID NO: 35801 - RNA, 21 nt, Artificial Sequence
  Marburg virus siRNA sense strand
ugacauugguucuuaugacuu

SEQ ID NO: 35802 - RNA, 21 nt, Artificial Sequence
  Marburg virus siRNA sense strand
gacauugguucuuaugacuuu

SEQ ID NO: 35803 - RNA, 21 nt, Artificial Sequence
  Marburg virus siRNA sense strand
acauugguucuuaugacuuuc

SEQ ID NO: 35804 - RNA, 21 nt, Artificial Sequence
  Marburg virus siRNA sense strand
cauugguucuuaugacuuucc

SEQ ID NO: 35805 - RNA, 21 nt, Artificial Sequence
  Marburg virus siRNA sense strand
auugguucuuaugacuuucca

SEQ ID NO: 35806 - RNA, 21 nt, Artificial Sequence
  Marburg virus siRNA sense strand
uugguucuuaugacuuuccaa

SEQ ID NO: 35807 - RNA, 21 nt, Artificial Sequence
  Marburg virus siRNA sense strand
ugguucuuaugacuuuccaac

SEQ ID NO: 35808 - RNA, 21 nt, Artificial Sequence
  Marburg virus siRNA sense strand
gguucuuaugacuuuccaacu

SEQ ID NO: 35809 - RNA, 21 nt, Artificial Sequence
  Marburg virus siRNA sense strand
guucuuaugacuuuccaacua

SEQ ID NO: 35810 - RNA, 21 nt, Artificial Sequence
  Marburg virus siRNA sense strand
uucuuaugacuuuccaacuau

SEQ ID NO: 35811 - RNA, 21 nt, Artificial Sequence
  Marburg virus siRNA sense strand
ucuuaugacuuuccaacuauu

SEQ ID NO: 35812 - RNA, 21 nt, Artificial Sequence
  Marburg virus siRNA sense strand
cuuaugacuuuccaacuauug

SEQ ID NO: 35813 - RNA, 21 nt, Artificial Sequence
  Marburg virus siRNA sense strand
uuaugacuuuccaacuauugc

SEQ ID NO: 35814 - RNA, 21 nt, Artificial Sequence
  Marburg virus siRNA sense strand
uaugacuuuccaacuauugcu

SEQ ID NO: 35815 - RNA, 21 nt, Artificial Sequence
  Marburg virus siRNA sense strand
augacuuuccaacuauugcug

SEQ ID NO: 35816 - RNA, 21 nt, Artificial Sequence
  Marburg virus siRNA sense strand
ugacuuuccaacuauugcugc

SEQ ID NO: 35817 - RNA, 21 nt, Artificial Sequence
  Marburg virus siRNA sense strand
gacuuuccaacuauugcugca

SEQ ID NO: 35818 - RNA, 21 nt, Artificial Sequence
  Marburg virus siRNA sense strand
acuuuccaacuauugcugcau

SEQ ID NO: 35819 - RNA, 21 nt, Artificial Sequence
  Marburg virus siRNA sense strand
cuuuccaacuauugcugcaug

SEQ ID NO: 35820 - RNA, 21 nt, Artificial Sequence
  Marburg virus siRNA sense strand
uuuccaacuauugcugcaugg

SEQ ID NO: 35821 - RNA, 21 nt, Artificial Sequence
  Marburg virus siRNA sense strand
uuccaacuauugcugcaugga

SEQ ID NO: 35822 - RNA, 21 nt, Artificial Sequence
  Marburg virus siRNA sense strand
uccaacuauugcugcauggac

SEQ ID NO: 35823 - RNA, 21 nt, Artificial Sequence
  Marburg virus siRNA sense strand
ccaacuauugcugcauggaca

SEQ ID NO: 35824 - RNA, 21 nt, Artificial Sequence
  Marburg virus siRNA sense strand
caacuauugcugcauggacac

SEQ ID NO: 35825 - RNA, 21 nt, Artificial Sequence
  Marburg virus siRNA sense strand
aacuauugcugcauggacacu

SEQ ID NO: 35826 - RNA, 21 nt, Artificial Sequence
  Marburg virus siRNA sense strand
acuauugcugcauggacacua

SEQ ID NO: 35827 - RNA, 21 nt, Artificial Sequence
  Marburg virus siRNA sense strand
cuauugcugcauggacacuag

SEQ ID NO: 35828 - RNA, 21 nt, Artificial Sequence
  Marburg virus siRNA sense strand
uauugcugcauggacacuagg

SEQ ID NO: 35829 - RNA, 21 nt, Artificial Sequence
  Marburg virus siRNA sense strand
auugcugcauggacacuagga

SEQ ID NO: 35830 - RNA, 21 nt, Artificial Sequence
  Marburg virus siRNA sense strand
uugcugcauggacacuaggag

SEQ ID NO: 35831 - RNA, 21 nt, Artificial Sequence
  Marburg virus siRNA sense strand
ugcugcauggacacuaggaga

SEQ ID NO: 35832 - RNA, 21 nt, Artificial Sequence
  Marburg virus siRNA sense strand
gcugcauggacacuaggagaa

SEQ ID NO: 35833 - RNA, 21 nt, Artificial Sequence
  Marburg virus siRNA sense strand
cugcauggacacuaggagaaa

SEQ ID NO: 35834 - RNA, 21 nt, Artificial Sequence
  Marburg virus siRNA sense strand
ugcauggacacuaggagaaac

SEQ ID NO: 35835 - RNA, 21 nt, Artificial Sequence
  Marburg virus siRNA sense strand
gcauggacacuaggagaaacu

SEQ ID NO: 35836 - RNA, 21 nt, Artificial Sequence
  Marburg virus siRNA sense strand
cauggacacuaggagaaacua

SEQ ID NO: 35837 - RNA, 21 nt, Artificial Sequence
  Marburg virus siRNA sense strand
auggacacuaggagaaacuau

SEQ ID NO: 35838 - RNA, 21 nt, Artificial Sequence
  Marburg virus siRNA sense strand
uggacacuaggagaaacuaua

SEQ ID NO: 35839 - RNA, 21 nt, Artificial Sequence
  Marburg virus siRNA sense strand
ggacacuaggagaaacuauag

SEQ ID NO: 35840 - RNA, 21 nt, Artificial Sequence
  Marburg virus siRNA sense strand
gacacuaggagaaacuauagu

SEQ ID NO: 35841 - RNA, 21 nt, Artificial Sequence
  Marburg virus siRNA sense strand
acacuaggagaaacuauaguc

SEQ ID NO: 35842 - RNA, 21 nt, Artificial Sequence
  Marburg virus siRNA sense strand
cacuaggagaaacuauagucg

SEQ ID NO: 35843 - RNA, 21 nt, Artificial Sequence
  Marburg virus siRNA sense strand
acuaggagaaacuauagucgg

SEQ ID NO: 35844 - RNA, 21 nt, Artificial Sequence
  Marburg virus siRNA sense strand
cuaggagaaacuauagucgga

SEQ ID NO: 35845 - RNA, 21 nt, Artificial Sequence
  Marburg virus siRNA sense strand
uaggagaaacuauagucggaa

SEQ ID NO: 35846 - RNA, 21 nt, Artificial Sequence
  Marburg virus siRNA sense strand
aggagaaacuauagucggaag

SEQ ID NO: 35847 - RNA, 21 nt, Artificial Sequence
  Marburg virus siRNA sense strand
ggagaaacuauagucggaagc

SEQ ID NO: 35848 - RNA, 21 nt, Artificial Sequence
  Marburg virus siRNA sense strand
gagaaacuauagucggaagca

SEQ ID NO: 35849 - RNA, 21 nt, Artificial Sequence
  Marburg virus siRNA sense strand
agaaacuauagucggaagcau

SEQ ID NO: 35850 - RNA, 21 nt, Artificial Sequence
  Marburg virus siRNA sense strand
gaaacuauagucggaagcauu

SEQ ID NO: 35851 - RNA, 21 nt, Artificial Sequence
  Marburg virus siRNA sense strand
aaacuauagucggaagcauuu

SEQ ID NO: 35852 - RNA, 21 nt, Artificial Sequence
  Marburg virus siRNA sense strand
aacuauagucggaagcauuuu

SEQ ID NO: 35853 - RNA, 21 nt, Artificial Sequence
  Marburg virus siRNA sense strand
acuauagucggaagcauuuuu

SEQ ID NO: 35854 - RNA, 21 nt, Artificial Sequence
  Marburg virus siRNA sense strand
cuauagucggaagcauuuuuu

SEQ ID NO: 35855 - RNA, 21 nt, Artificial Sequence
  Marburg virus siRNA sense strand
uauagucggaagcauuuuuuc

SEQ ID NO: 35856 - RNA, 21 nt, Artificial Sequence
  Marburg virus siRNA sense strand
auagucggaagcauuuuuucu

SEQ ID NO: 35857 - RNA, 21 nt, Artificial Sequence
  Marburg virus siRNA sense strand
uagucggaagcauuuuuucug

SEQ ID NO: 35858 - RNA, 21 nt, Artificial Sequence
  Marburg virus siRNA sense strand
agucggaagcauuuuuucuga

SEQ ID NO: 35859 - RNA, 21 nt, Artificial Sequence
  Marburg virus siRNA sense strand
gucggaagcauuuuuucugau

SEQ ID NO: 35860 - RNA, 21 nt, Artificial Sequence
  Marburg virus siRNA sense strand
ucggaagcauuuuuucugaug

SEQ ID NO: 35861 - RNA, 21 nt, Artificial Sequence
  Marburg virus siRNA sense strand
cggaagcauuuuuucugauga

SEQ ID NO: 35862 - RNA, 21 nt, Artificial Sequence
  Marburg virus siRNA sense strand
ggaagcauuuuuucugaugag

SEQ ID NO: 35863 - RNA, 21 nt, Artificial Sequence
  Marburg virus siRNA sense strand
gaagcauuuuuucugaugagu

SEQ ID NO: 35864 - RNA, 21 nt, Artificial Sequence
  Marburg virus siRNA sense strand
aagcauuuuuucugaugaguc

SEQ ID NO: 35865 - RNA, 21 nt, Artificial Sequence
  Marburg virus siRNA sense strand
agcauuuuuucugaugagucu

SEQ ID NO: 35866 - RNA, 21 nt, Artificial Sequence
  Marburg virus siRNA sense strand
gcauuuuuucugaugagucuu

SEQ ID NO: 35867 - RNA, 21 nt, Artificial Sequence
  Marburg virus siRNA sense strand
cauuuuuucugaugagucuuc

SEQ ID NO: 35868 - RNA, 21 nt, Artificial Sequence
  Marburg virus siRNA sense strand
auuuuuucugaugagucuucu

SEQ ID NO: 35869 - RNA, 21 nt, Artificial Sequence
  Marburg virus siRNA sense strand
uuuuuucugaugagucuucuc

SEQ ID NO: 35870 - RNA, 21 nt, Artificial Sequence
  Marburg virus siRNA sense strand
uuuuucugaugagucuucuca

SEQ ID NO: 35871 - RNA, 21 nt, Artificial Sequence
  Marburg virus siRNA sense strand
uuuucugaugagucuucucaa

SEQ ID NO: 35872 - RNA, 21 nt, Artificial Sequence
  Marburg virus siRNA sense strand
uuucugaugagucuucucaaa

SEQ ID NO: 35873 - RNA, 21 nt, Artificial Sequence
  Marburg virus siRNA sense strand
uucugaugagucuucucaaag

SEQ ID NO: 35874 - RNA, 21 nt, Artificial Sequence
  Marburg virus siRNA sense strand
ucugaugagucuucucaaagu

SEQ ID NO: 35875 - RNA, 21 nt, Artificial Sequence
  Marburg virus siRNA sense strand
cugaugagucuucucaaagua

SEQ ID NO: 35876 - RNA, 21 nt, Artificial Sequence
  Marburg virus siRNA sense strand
ugaugagucuucucaaaguac

SEQ ID NO: 35877 - RNA, 21 nt, Artificial Sequence
  Marburg virus siRNA sense strand
gaugagucuucucaaaguaca

SEQ ID NO: 35878 - RNA, 21 nt, Artificial Sequence
  Marburg virus siRNA sense strand
augagucuucucaaaguacag

SEQ ID NO: 35879 - RNA, 21 nt, Artificial Sequence
  Marburg virus siRNA sense strand
ugagucuucucaaaguacaga

SEQ ID NO: 35880 - RNA, 21 nt, Artificial Sequence
  Marburg virus siRNA sense strand
gagucuucucaaaguacagau

SEQ ID NO: 35881 - RNA, 21 nt, Artificial Sequence
  Marburg virus siRNA sense strand
agucuucucaaaguacagauc

SEQ ID NO: 35882 - RNA, 21 nt, Artificial Sequence
  Marburg virus siRNA sense strand
gucuucucaaaguacagaucc

SEQ ID NO: 35883 - RNA, 21 nt, Artificial Sequence
  Marburg virus siRNA sense strand
ucuucucaaaguacagaucca

SEQ ID NO: 35884 - RNA, 21 nt, Artificial Sequence
  Marburg virus siRNA sense strand
cuucucaaaguacagauccaa

SEQ ID NO: 35885 - RNA, 21 nt, Artificial Sequence
  Marburg virus siRNA sense strand
uucucaaaguacagauccaau

SEQ ID NO: 35886 - RNA, 21 nt, Artificial Sequence
  Marburg virus siRNA sense strand
ucucaaaguacagauccaaua

SEQ ID NO: 35887 - RNA, 21 nt, Artificial Sequence
  Marburg virus siRNA sense strand
cucaaaguacagauccaauaa

SEQ ID NO: 35888 - RNA, 21 nt, Artificial Sequence
  Marburg virus siRNA sense strand
ucaaaguacagauccaauaag

SEQ ID NO: 35889 - RNA, 21 nt, Artificial Sequence
  Marburg virus siRNA sense strand
caaaguacagauccaauaagu

SEQ ID NO: 35890 - RNA, 21 nt, Artificial Sequence
  Marburg virus siRNA sense strand
aaaguacagauccaauaaguu

SEQ ID NO: 35891 - RNA, 21 nt, Artificial Sequence
  Marburg virus siRNA sense strand
aaguacagauccaauaaguuc

SEQ ID NO: 35892 - RNA, 21 nt, Artificial Sequence
  Marburg virus siRNA sense strand
aguacagauccaauaaguuca

SEQ ID NO: 35893 - RNA, 21 nt, Artificial Sequence
  Marburg virus siRNA sense strand
guacagauccaauaaguucag

SEQ ID NO: 35894 - RNA, 21 nt, Artificial Sequence
  Marburg virus siRNA sense strand
uacagauccaauaaguucagg

SEQ ID NO: 35895 - RNA, 21 nt, Artificial Sequence
  Marburg virus siRNA sense strand
acagauccaauaaguucaggu

SEQ ID NO: 35896 - RNA, 21 nt, Artificial Sequence
  Marburg virus siRNA sense strand
cagauccaauaaguucagguu

SEQ ID NO: 35897 - RNA, 21 nt, Artificial Sequence
  Marburg virus siRNA sense strand
agauccaauaaguucagguug

SEQ ID NO: 35898 - RNA, 21 nt, Artificial Sequence
  Marburg virus siRNA sense strand
gauccaauaaguucagguugc

SEQ ID NO: 35899 - RNA, 21 nt, Artificial Sequence
  Marburg virus siRNA sense strand
auccaauaaguucagguugca

SEQ ID NO: 35900 - RNA, 21 nt, Artificial Sequence
  Marburg virus siRNA sense strand
uccaauaaguucagguugcac

SEQ ID NO: 35901 - RNA, 21 nt, Artificial Sequence
  Marburg virus siRNA sense strand
ccaauaaguucagguugcaca

SEQ ID NO: 35902 - RNA, 21 nt, Artificial Sequence
  Marburg virus siRNA sense strand
caauaaguucagguugcacaa

SEQ ID NO: 35903 - RNA, 21 nt, Artificial Sequence
  Marburg virus siRNA sense strand
aauaaguucagguugcacaaa

SEQ ID NO: 35904 - RNA, 21 nt, Artificial Sequence
  Marburg virus siRNA sense strand
auaaguucagguugcacaaaa

SEQ ID NO: 35905 - RNA, 21 nt, Artificial Sequence
  Marburg virus siRNA sense strand
uaaguucagguugcacaaaaa

SEQ ID NO: 35906 - RNA, 21 nt, Artificial Sequence
  Marburg virus siRNA sense strand
aaguucagguugcacaaaaac

SEQ ID NO: 35907 - RNA, 21 nt, Artificial Sequence
  Marburg virus siRNA sense strand
aguucagguugcacaaaaacu

SEQ ID NO: 35908 - RNA, 21 nt, Artificial Sequence
  Marburg virus siRNA sense strand
guucagguugcacaaaaacuu

SEQ ID NO: 35909 - RNA, 21 nt, Artificial Sequence
  Marburg virus siRNA sense strand
uucagguugcacaaaaacuuu

SEQ ID NO: 35910 - RNA, 21 nt, Artificial Sequence
  Marburg virus siRNA sense strand
ucagguugcacaaaaacuuuc

SEQ ID NO: 35911 - RNA, 21 nt, Artificial Sequence
  Marburg virus siRNA sense strand
cagguugcacaaaaacuuucg

SEQ ID NO: 35912 - RNA, 21 nt, Artificial Sequence
  Marburg virus siRNA sense strand
agguugcacaaaaacuuucgu

SEQ ID NO: 35913 - RNA, 21 nt, Artificial Sequence
  Marburg virus siRNA sense strand
gguugcacaaaaacuuucguc

SEQ ID NO: 35914 - RNA, 21 nt, Artificial Sequence
  Marburg virus siRNA sense strand
guugcacaaaaacuuucguca

SEQ ID NO: 35915 - RNA, 21 nt, Artificial Sequence
  Marburg virus siRNA sense strand
uugcacaaaaacuuucgucac

SEQ ID NO: 35916 - RNA, 21 nt, Artificial Sequence
  Marburg virus siRNA sense strand
ugcacaaaaacuuucgucaca

SEQ ID NO: 35917 - RNA, 21 nt, Artificial Sequence
  Marburg virus siRNA sense strand
gcacaaaaacuuucgucacac

SEQ ID NO: 35918 - RNA, 21 nt, Artificial Sequence
  Marburg virus siRNA sense strand
cacaaaaacuuucgucacaca

SEQ ID NO: 35919 - RNA, 21 nt, Artificial Sequence
  Marburg virus siRNA sense strand
acaaaaacuuucgucacacau

SEQ ID NO: 35920 - RNA, 21 nt, Artificial Sequence
  Marburg virus siRNA sense strand
caaaaacuuucgucacacauu

SEQ ID NO: 35921 - RNA, 21 nt, Artificial Sequence
  Marburg virus siRNA sense strand
aaaaacuuucgucacacauuu

SEQ ID NO: 35922 - RNA, 21 nt, Artificial Sequence
  Marburg virus siRNA sense strand
aaaacuuucgucacacauuuc

SEQ ID NO: 35923 - RNA, 21 nt, Artificial Sequence
  Marburg virus siRNA sense strand
aaacuuucgucacacauuucc

SEQ ID NO: 35924 - RNA, 21 nt, Artificial Sequence
  Marburg virus siRNA sense strand
aacuuucgucacacauuuccu

SEQ ID NO: 35925 - RNA, 21 nt, Artificial Sequence
  Marburg virus siRNA sense strand
acuuucgucacacauuuccuu

SEQ ID NO: 35926 - RNA, 21 nt, Artificial Sequence
  Marburg virus siRNA sense strand
cuuucgucacacauuuccuug

SEQ ID NO: 35927 - RNA, 21 nt, Artificial Sequence
  Marburg virus siRNA sense strand
uuucgucacacauuuccuugu

SEQ ID NO: 35928 - RNA, 21 nt, Artificial Sequence
  Marburg virus siRNA sense strand
uucgucacacauuuccuugug

SEQ ID NO: 35929 - RNA, 21 nt, Artificial Sequence
  Marburg virus siRNA sense strand
ucgucacacauuuccuugugu

SEQ ID NO: 35930 - RNA, 21 nt, Artificial Sequence
  Marburg virus siRNA sense strand
cgucacacauuuccuugugua

SEQ ID NO: 35931 - RNA, 21 nt, Artificial Sequence
  Marburg virus siRNA sense strand
gucacacauuuccuuguguau

SEQ ID NO: 35932 - RNA, 21 nt, Artificial Sequence
  Marburg virus siRNA sense strand
ucacacauuuccuuguguauc

SEQ ID NO: 35933 - RNA, 21 nt, Artificial Sequence
  Marburg virus siRNA sense strand
cacacauuuccuuguguaucc

SEQ ID NO: 35934 - RNA, 21 nt, Artificial Sequence
  Marburg virus siRNA sense strand
acacauuuccuuguguaucca

SEQ ID NO: 35935 - RNA, 21 nt, Artificial Sequence
  Marburg virus siRNA sense strand
cacauuuccuuguguauccag

SEQ ID NO: 35936 - RNA, 21 nt, Artificial Sequence
  Marburg virus siRNA sense strand
acauuuccuuguguauccagu

SEQ ID NO: 35937 - RNA, 21 nt, Artificial Sequence
  Marburg virus siRNA sense strand
cauuuccuuguguauccaguu

SEQ ID NO: 35938 - RNA, 21 nt, Artificial Sequence
  Marburg virus siRNA sense strand
auuuccuuguguauccaguug

SEQ ID NO: 35939 - RNA, 21 nt, Artificial Sequence
  Marburg virus siRNA sense strand
uuuccuuguguauccaguuga

SEQ ID NO: 35940 - RNA, 21 nt, Artificial Sequence
  Marburg virus siRNA sense strand
uuccuuguguauccaguugag

SEQ ID NO: 35941 - RNA, 21 nt, Artificial Sequence
  Marburg virus siRNA sense strand
uccuuguguauccaguugaga

SEQ ID NO: 35942 - RNA, 21 nt, Artificial Sequence
  Marburg virus siRNA sense strand
ccuuguguauccaguugagag

SEQ ID NO: 35943 - RNA, 21 nt, Artificial Sequence
  Marburg virus siRNA sense strand
cuuguguauccaguugagagu

SEQ ID NO: 35944 - RNA, 21 nt, Artificial Sequence
  Marburg virus siRNA sense strand
uuguguauccaguugagagua

SEQ ID NO: 35945 - RNA, 21 nt, Artificial Sequence
  Marburg virus siRNA sense strand
uguguauccaguugagaguau

SEQ ID NO: 35946 - RNA, 21 nt, Artificial Sequence
  Marburg virus siRNA sense strand
guguauccaguugagaguauu

SEQ ID NO: 35947 - RNA, 21 nt, Artificial Sequence
  Marburg virus siRNA sense strand
uguauccaguugagaguauuu

SEQ ID NO: 35948 - RNA, 21 nt, Artificial Sequence
  Marburg virus siRNA sense strand
guauccaguugagaguauuuu

SEQ ID NO: 35949 - RNA, 21 nt, Artificial Sequence
  Marburg virus siRNA sense strand
uauccaguugagaguauuuuu

SEQ ID NO: 35950 - RNA, 21 nt, Artificial Sequence
  Marburg virus siRNA sense strand
auccaguugagaguauuuuuu

SEQ ID NO: 35951 - RNA, 21 nt, Artificial Sequence
  Marburg virus siRNA sense strand
uccaguugagaguauuuuuua

SEQ ID NO: 35952 - RNA, 21 nt, Artificial Sequence
  Marburg virus siRNA sense strand
ccaguugagaguauuuuuuau

SEQ ID NO: 35953 - RNA, 21 nt, Artificial Sequence
  Marburg virus siRNA sense strand
caguugagaguauuuuuuaug

SEQ ID NO: 35954 - RNA, 21 nt, Artificial Sequence
  Marburg virus siRNA sense strand
aguugagaguauuuuuuaugc

SEQ ID NO: 35955 - RNA, 21 nt, Artificial Sequence
  Marburg virus siRNA sense strand
guugagaguauuuuuuaugca

SEQ ID NO: 35956 - RNA, 21 nt, Artificial Sequence
  Marburg virus siRNA sense strand
uugagaguauuuuuuaugcau

SEQ ID NO: 35957 - RNA, 21 nt, Artificial Sequence
  Marburg virus siRNA sense strand
ugagaguauuuuuuaugcauu

SEQ ID NO: 35958 - RNA, 21 nt, Artificial Sequence
  Marburg virus siRNA sense strand
gagaguauuuuuuaugcauuc

SEQ ID NO: 35959 - RNA, 21 nt, Artificial Sequence
  Marburg virus siRNA sense strand
agaguauuuuuuaugcauucg

SEQ ID NO: 35960 - RNA, 21 nt, Artificial Sequence
  Marburg virus siRNA sense strand
gaguauuuuuuaugcauucgg

SEQ ID NO: 35961 - RNA, 21 nt, Artificial Sequence
  Marburg virus siRNA sense strand
aguauuuuuuaugcauucggg

SEQ ID NO: 35962 - RNA, 21 nt, Artificial Sequence
  Marburg virus siRNA sense strand
guauuuuuuaugcauucgggg

SEQ ID NO: 35963 - RNA, 21 nt, Artificial Sequence
  Marburg virus siRNA sense strand
uauuuuuuaugcauucggggc

SEQ ID NO: 35964 - RNA, 21 nt, Artificial Sequence
  Marburg virus siRNA sense strand
auuuuuuaugcauucggggcu

SEQ ID NO: 35965 - RNA, 21 nt, Artificial Sequence
  Marburg virus siRNA sense strand
uuuuuuaugcauucggggcua

SEQ ID NO: 35966 - RNA, 21 nt, Artificial Sequence
  Marburg virus siRNA sense strand
uuuuuaugcauucggggcuaa

SEQ ID NO: 35967 - RNA, 21 nt, Artificial Sequence
  Marburg virus siRNA sense strand
uuuuaugcauucggggcuaac

SEQ ID NO: 35968 - RNA, 21 nt, Artificial Sequence
  Marburg virus siRNA sense strand
uuuaugcauucggggcuaacu

SEQ ID NO: 35969 - RNA, 21 nt, Artificial Sequence
  Marburg virus siRNA sense strand
uuaugcauucggggcuaacuu

SEQ ID NO: 35970 - RNA, 21 nt, Artificial Sequence
  Marburg virus siRNA sense strand
uaugcauucggggcuaacuua

SEQ ID NO: 35971 - RNA, 21 nt, Artificial Sequence
  Marburg virus siRNA sense strand
augcauucggggcuaacuuaa

SEQ ID NO: 35972 - RNA, 21 nt, Artificial Sequence
  Marburg virus siRNA sense strand
ugcauucggggcuaacuuaau

SEQ ID NO: 35973 - RNA, 21 nt, Artificial Sequence
  Marburg virus siRNA sense strand
gcauucggggcuaacuuaaua

SEQ ID NO: 35974 - RNA, 21 nt, Artificial Sequence
  Marburg virus siRNA sense strand
cauucggggcuaacuuaauag

SEQ ID NO: 35975 - RNA, 21 nt, Artificial Sequence
  Marburg virus siRNA sense strand
auucggggcuaacuuaauagu

SEQ ID NO: 35976 - RNA, 21 nt, Artificial Sequence
  Marburg virus siRNA sense strand
uucggggcuaacuuaauagua

SEQ ID NO: 35977 - RNA, 21 nt, Artificial Sequence
  Marburg virus siRNA sense strand
ucggggcuaacuuaauaguag

SEQ ID NO: 35978 - RNA, 21 nt, Artificial Sequence
  Marburg virus siRNA sense strand
cggggcuaacuuaauaguaga

SEQ ID NO: 35979 - RNA, 21 nt, Artificial Sequence
  Marburg virus siRNA sense strand
ggggcuaacuuaauaguagaa

SEQ ID NO: 35980 - RNA, 21 nt, Artificial Sequence
  Marburg virus siRNA sense strand
gggcuaacuuaauaguagaaa

SEQ ID NO: 35981 - RNA, 21 nt, Artificial Sequence
  Marburg virus siRNA sense strand
ggcuaacuuaauaguagaaag

SEQ ID NO: 35982 - RNA, 21 nt, Artificial Sequence
  Marburg virus siRNA sense strand
gcuaacuuaauaguagaaagu

SEQ ID NO: 35983 - RNA, 21 nt, Artificial Sequence
  Marburg virus siRNA sense strand
cuaacuuaauaguagaaaguu

SEQ ID NO: 35984 - RNA, 21 nt, Artificial Sequence
  Marburg virus siRNA sense strand
uaacuuaauaguagaaaguuu

SEQ ID NO: 35985 - RNA, 21 nt, Artificial Sequence
  Marburg virus siRNA sense strand
aacuuaauaguagaaaguuua

SEQ ID NO: 35986 - RNA, 21 nt, Artificial Sequence
  Marburg virus siRNA sense strand
acuuaauaguagaaaguuuaa

SEQ ID NO: 35987 - RNA, 21 nt, Artificial Sequence
  Marburg virus siRNA sense strand
cuuaauaguagaaaguuuaag

SEQ ID NO: 35988 - RNA, 21 nt, Artificial Sequence
  Marburg virus siRNA sense strand
uuaauaguagaaaguuuaagu

SEQ ID NO: 35989 - RNA, 21 nt, Artificial Sequence
  Marburg virus siRNA sense strand
uaauaguagaaaguuuaaguc

SEQ ID NO: 35990 - RNA, 21 nt, Artificial Sequence
  Marburg virus siRNA sense strand
aauaguagaaaguuuaagucu

SEQ ID NO: 35991 - RNA, 21 nt, Artificial Sequence
  Marburg virus siRNA sense strand
auaguagaaaguuuaagucua

SEQ ID NO: 35992 - RNA, 21 nt, Artificial Sequence
  Marburg virus siRNA sense strand
uaguagaaaguuuaagucuaa

SEQ ID NO: 35993 - RNA, 21 nt, Artificial Sequence
  Marburg virus siRNA sense strand
aguagaaaguuuaagucuaag

SEQ ID NO: 35994 - RNA, 21 nt, Artificial Sequence
  Marburg virus siRNA sense strand
guagaaaguuuaagucuaagu

SEQ ID NO: 35995 - RNA, 21 nt, Artificial Sequence
  Marburg virus siRNA sense strand
uagaaaguuuaagucuaagua

SEQ ID NO: 35996 - RNA, 21 nt, Artificial Sequence
  Marburg virus siRNA sense strand
agaaaguuuaagucuaaguag

SEQ ID NO: 35997 - RNA, 21 nt, Artificial Sequence
  Marburg virus siRNA sense strand
gaaaguuuaagucuaaguagg

SEQ ID NO: 35998 - RNA, 21 nt, Artificial Sequence
  Marburg virus siRNA sense strand
aaaguuuaagucuaaguagga

SEQ ID NO: 35999 - RNA, 21 nt, Artificial Sequence
  Marburg virus siRNA sense strand
aaguuuaagucuaaguaggau

SEQ ID NO: 36000 - RNA, 21 nt, Artificial Sequence
  Marburg virus siRNA sense strand
aguuuaagucuaaguaggauc

SEQ ID NO: 36001 - RNA, 21 nt, Artificial Sequence
  Marburg virus siRNA sense strand
guuuaagucuaaguaggauca

SEQ ID NO: 36002 - RNA, 21 nt, Artificial Sequence
  Marburg virus siRNA sense strand
uuuaagucuaaguaggaucaa

SEQ ID NO: 36003 - RNA, 21 nt, Artificial Sequence
  Marburg virus siRNA sense strand
uuaagucuaaguaggaucaaa

SEQ ID NO: 36004 - RNA, 21 nt, Artificial Sequence
  Marburg virus siRNA sense strand
uaagucuaaguaggaucaaau

SEQ ID NO: 36005 - RNA, 21 nt, Artificial Sequence
  Marburg virus siRNA sense strand
aagucuaaguaggaucaaauc

SEQ ID NO: 36006 - RNA, 21 nt, Artificial Sequence
  Marburg virus siRNA sense strand
agucuaaguaggaucaaauca

SEQ ID NO: 36007 - RNA, 21 nt, Artificial Sequence
  Marburg virus siRNA sense strand
gucuaaguaggaucaaaucaa

SEQ ID NO: 36008 - RNA, 21 nt, Artificial Sequence
  Marburg virus siRNA sense strand
ucuaaguaggaucaaaucaau

SEQ ID NO: 36009 - RNA, 21 nt, Artificial Sequence
  Marburg virus siRNA sense strand
cuaaguaggaucaaaucaauu

SEQ ID NO: 36010 - RNA, 21 nt, Artificial Sequence
  Marburg virus siRNA sense strand
uaaguaggaucaaaucaauua

SEQ ID NO: 36011 - RNA, 21 nt, Artificial Sequence
  Marburg virus siRNA sense strand
aaguaggaucaaaucaauuaa

SEQ ID NO: 36012 - RNA, 21 nt, Artificial Sequence
  Marburg virus siRNA sense strand
aguaggaucaaaucaauuaag

SEQ ID NO: 36013 - RNA, 21 nt, Artificial Sequence
  Marburg virus siRNA sense strand
guaggaucaaaucaauuaaga

SEQ ID NO: 36014 - RNA, 21 nt, Artificial Sequence
  Marburg virus siRNA sense strand
uaggaucaaaucaauuaagaa

SEQ ID NO: 36015 - RNA, 21 nt, Artificial Sequence
  Marburg virus siRNA sense strand
aggaucaaaucaauuaagaac

SEQ ID NO: 36016 - RNA, 21 nt, Artificial Sequence
  Marburg virus siRNA sense strand
ggaucaaaucaauuaagaacc

SEQ ID NO: 36017 - RNA, 21 nt, Artificial Sequence
  Marburg virus siRNA sense strand
gaucaaaucaauuaagaaccu

SEQ ID NO: 36018 - RNA, 21 nt, Artificial Sequence
  Marburg virus siRNA sense strand
aucaaaucaauuaagaaccuc

SEQ ID NO: 36019 - RNA, 21 nt, Artificial Sequence
  Marburg virus siRNA sense strand
ucaaaucaauuaagaaccucu

SEQ ID NO: 36020 - RNA, 21 nt, Artificial Sequence
  Marburg virus siRNA sense strand
caaaucaauuaagaaccucuc

SEQ ID NO: 36021 - RNA, 21 nt, Artificial Sequence
  Marburg virus siRNA sense strand
aaaucaauuaagaaccucuca

SEQ ID NO: 36022 - RNA, 21 nt, Artificial Sequence
  Marburg virus siRNA sense strand
aaucaauuaagaaccucucag

SEQ ID NO: 36023 - RNA, 21 nt, Artificial Sequence
  Marburg virus siRNA sense strand
aucaauuaagaaccucucaga

SEQ ID NO: 36024 - RNA, 21 nt, Artificial Sequence
  Marburg virus siRNA sense strand
ucaauuaagaaccucucagau

SEQ ID NO: 36025 - RNA, 21 nt, Artificial Sequence
  Marburg virus siRNA sense strand
caauuaagaaccucucagauu

SEQ ID NO: 36026 - RNA, 21 nt, Artificial Sequence
  Marburg virus siRNA sense strand
aauuaagaaccucucagauuu

SEQ ID NO: 36027 - RNA, 21 nt, Artificial Sequence
  Marburg virus siRNA sense strand
auuaagaaccucucagauuug

SEQ ID NO: 36028 - RNA, 21 nt, Artificial Sequence
  Marburg virus siRNA sense strand
uuaagaaccucucagauuuga

SEQ ID NO: 36029 - RNA, 21 nt, Artificial Sequence
  Marburg virus siRNA sense strand
uaagaaccucucagauuugac

SEQ ID NO: 36030 - RNA, 21 nt, Artificial Sequence
  Marburg virus siRNA sense strand
aagaaccucucagauuugaca

SEQ ID NO: 36031 - RNA, 21 nt, Artificial Sequence
  Marburg virus siRNA sense strand
agaaccucucagauuugacau

SEQ ID NO: 36032 - RNA, 21 nt, Artificial Sequence
  Marburg virus siRNA sense strand
gaaccucucagauuugacauu

SEQ ID NO: 36033 - RNA, 21 nt, Artificial Sequence
  Marburg virus siRNA sense strand
aaccucucagauuugacauuc

SEQ ID NO: 36034 - RNA, 21 nt, Artificial Sequence
  Marburg virus siRNA sense strand
accucucagauuugacauucc

SEQ ID NO: 36035 - RNA, 21 nt, Artificial Sequence
  Marburg virus siRNA sense strand
ccucucagauuugacauuccu

SEQ ID NO: 36036 - RNA, 21 nt, Artificial Sequence
  Marburg virus siRNA sense strand
cucucagauuugacauuccuu

SEQ ID NO: 36037 - RNA, 21 nt, Artificial Sequence
  Marburg virus siRNA sense strand
ucucagauuugacauuccuua

SEQ ID NO: 36038 - RNA, 21 nt, Artificial Sequence
  Marburg virus siRNA sense strand
cucagauuugacauuccuuau

SEQ ID NO: 36039 - RNA, 21 nt, Artificial Sequence
  Marburg virus siRNA sense strand
ucagauuugacauuccuuaua

SEQ ID NO: 36040 - RNA, 21 nt, Artificial Sequence
  Marburg virus siRNA sense strand
cagauuugacauuccuuauau

SEQ ID NO: 36041 - RNA, 21 nt, Artificial Sequence
  Marburg virus siRNA sense strand
agauuugacauuccuuauauc

SEQ ID NO: 36042 - RNA, 21 nt, Artificial Sequence
  Marburg virus siRNA sense strand
gauuugacauuccuuauauca

SEQ ID NO: 36043 - RNA, 21 nt, Artificial Sequence
  Marburg virus siRNA sense strand
auuugacauuccuuauaucau

SEQ ID NO: 36044 - RNA, 21 nt, Artificial Sequence
  Marburg virus siRNA sense strand
uuugacauuccuuauaucauc

SEQ ID NO: 36045 - RNA, 21 nt, Artificial Sequence
  Marburg virus siRNA sense strand
uugacauuccuuauaucaucc

SEQ ID NO: 36046 - RNA, 21 nt, Artificial Sequence
  Marburg virus siRNA sense strand
ugacauuccuuauaucaucca

SEQ ID NO: 36047 - RNA, 21 nt, Artificial Sequence
  Marburg virus siRNA sense strand
gacauuccuuauaucauccac

SEQ ID NO: 36048 - RNA, 21 nt, Artificial Sequence
  Marburg virus siRNA sense strand
acauuccuuauaucauccaca

SEQ ID NO: 36049 - RNA, 21 nt, Artificial Sequence
  Marburg virus siRNA sense strand
cauuccuuauaucauccacaa

SEQ ID NO: 36050 - RNA, 21 nt, Artificial Sequence
  Marburg virus siRNA sense strand
auuccuuauaucauccacaau

SEQ ID NO: 36051 - RNA, 21 nt, Artificial Sequence
  Marburg virus siRNA sense strand
uuccuuauaucauccacaauc

SEQ ID NO: 36052 - RNA, 21 nt, Artificial Sequence
  Marburg virus siRNA sense strand
uccuuauaucauccacaauca

SEQ ID NO: 36053 - RNA, 21 nt, Artificial Sequence
  Marburg virus siRNA sense strand
ccuuauaucauccacaaucag

SEQ ID NO: 36054 - RNA, 21 nt, Artificial Sequence
  Marburg virus siRNA sense strand
cuuauaucauccacaaucagg

SEQ ID NO: 36055 - RNA, 21 nt, Artificial Sequence
  Marburg virus siRNA sense strand
uuauaucauccacaaucagga

SEQ ID NO: 36056 - RNA, 21 nt, Artificial Sequence
  Marburg virus siRNA sense strand
uauaucauccacaaucaggaa

SEQ ID NO: 36057 - RNA, 21 nt, Artificial Sequence
  Marburg virus siRNA sense strand
auaucauccacaaucaggaau

SEQ ID NO: 36058 - RNA, 21 nt, Artificial Sequence
  Marburg virus siRNA sense strand
uaucauccacaaucaggaauu

SEQ ID NO: 36059 - RNA, 21 nt, Artificial Sequence
  Marburg virus siRNA sense strand
aucauccacaaucaggaauuu

SEQ ID NO: 36060 - RNA, 21 nt, Artificial Sequence
  Marburg virus siRNA sense strand
ucauccacaaucaggaauuua

SEQ ID NO: 36061 - RNA, 21 nt, Artificial Sequence
  Marburg virus siRNA sense strand
cauccacaaucaggaauuuau

SEQ ID NO: 36062 - RNA, 21 nt, Artificial Sequence
  Marburg virus siRNA sense strand
auccacaaucaggaauuuauc

SEQ ID NO: 36063 - RNA, 21 nt, Artificial Sequence
  Marburg virus siRNA sense strand
uccacaaucaggaauuuauca

SEQ ID NO: 36064 - RNA, 21 nt, Artificial Sequence
  Marburg virus siRNA sense strand
ccacaaucaggaauuuaucac

SEQ ID NO: 36065 - RNA, 21 nt, Artificial Sequence
  Marburg virus siRNA sense strand
cacaaucaggaauuuaucaca

SEQ ID NO: 36066 - RNA, 21 nt, Artificial Sequence
  Marburg virus siRNA sense strand
acaaucaggaauuuaucacau

SEQ ID NO: 36067 - RNA, 21 nt, Artificial Sequence
  Marburg virus siRNA sense strand
caaucaggaauuuaucacaua

SEQ ID NO: 36068 - RNA, 21 nt, Artificial Sequence
  Marburg virus siRNA sense strand
aaucaggaauuuaucacauag

SEQ ID NO: 36069 - RNA, 21 nt, Artificial Sequence
  Marburg virus siRNA sense strand
aucaggaauuuaucacauaga

SEQ ID NO: 36070 - RNA, 21 nt, Artificial Sequence
  Marburg virus siRNA sense strand
ucaggaauuuaucacauagau

SEQ ID NO: 36071 - RNA, 21 nt, Artificial Sequence
  Marburg virus siRNA sense strand
caggaauuuaucacauagauc

SEQ ID NO: 36072 - RNA, 21 nt, Artificial Sequence
  Marburg virus siRNA sense strand
aggaauuuaucacauagauca

SEQ ID NO: 36073 - RNA, 21 nt, Artificial Sequence
  Marburg virus siRNA sense strand
ggaauuuaucacauagaucac

SEQ ID NO: 36074 - RNA, 21 nt, Artificial Sequence
  Marburg virus siRNA sense strand
gaauuuaucacauagaucacu

SEQ ID NO: 36075 - RNA, 21 nt, Artificial Sequence
  Marburg virus siRNA sense strand
aauuuaucacauagaucacuu

SEQ ID NO: 36076 - RNA, 21 nt, Artificial Sequence
  Marburg virus siRNA sense strand
auuuaucacauagaucacuuc

SEQ ID NO: 36077 - RNA, 21 nt, Artificial Sequence
  Marburg virus siRNA sense strand
uuuaucacauagaucacuucg

SEQ ID NO: 36078 - RNA, 21 nt, Artificial Sequence
  Marburg virus siRNA sense strand
uuaucacauagaucacuucgg

SEQ ID NO: 36079 - RNA, 21 nt, Artificial Sequence
  Marburg virus siRNA sense strand
uaucacauagaucacuucgga

SEQ ID NO: 36080 - RNA, 21 nt, Artificial Sequence
  Marburg virus siRNA sense strand
aucacauagaucacuucggau

SEQ ID NO: 36081 - RNA, 21 nt, Artificial Sequence
  Marburg virus siRNA sense strand
ucacauagaucacuucggauu

SEQ ID NO: 36082 - RNA, 21 nt, Artificial Sequence
  Marburg virus siRNA sense strand
cacauagaucacuucggauuc

SEQ ID NO: 36083 - RNA, 21 nt, Artificial Sequence
  Marburg virus siRNA sense strand
acauagaucacuucggauucu

SEQ ID NO: 36084 - RNA, 21 nt, Artificial Sequence
  Marburg virus siRNA sense strand
cauagaucacuucggauucuu

SEQ ID NO: 36085 - RNA, 21 nt, Artificial Sequence
  Marburg virus siRNA sense strand
auagaucacuucggauucuuc

SEQ ID NO: 36086 - RNA, 21 nt, Artificial Sequence
  Marburg virus siRNA sense strand
uagaucacuucggauucuuca

SEQ ID NO: 36087 - RNA, 21 nt, Artificial Sequence
  Marburg virus siRNA sense strand
agaucacuucggauucuucaa

SEQ ID NO: 36088 - RNA, 21 nt, Artificial Sequence
  Marburg virus siRNA sense strand
gaucacuucggauucuucaau

SEQ ID NO: 36089 - RNA, 21 nt, Artificial Sequence
  Marburg virus siRNA sense strand
aucacuucggauucuucaauc

SEQ ID NO: 36090 - RNA, 21 nt, Artificial Sequence
  Marburg virus siRNA sense strand
ucacuucggauucuucaaucu

SEQ ID NO: 36091 - RNA, 21 nt, Artificial Sequence
  Marburg virus siRNA sense strand
cacuucggauucuucaaucua

SEQ ID NO: 36092 - RNA, 21 nt, Artificial Sequence
  Marburg virus siRNA sense strand
acuucggauucuucaaucuac

SEQ ID NO: 36093 - RNA, 21 nt, Artificial Sequence
  Marburg virus siRNA sense strand
cuucggauucuucaaucuacc

SEQ ID NO: 36094 - RNA, 21 nt, Artificial Sequence
  Marburg virus siRNA sense strand
uucggauucuucaaucuaccu

SEQ ID NO: 36095 - RNA, 21 nt, Artificial Sequence
  Marburg virus siRNA sense strand
ucggauucuucaaucuaccuu

SEQ ID NO: 36096 - RNA, 21 nt, Artificial Sequence
  Marburg virus siRNA sense strand
cggauucuucaaucuaccuuc

SEQ ID NO: 36097 - RNA, 21 nt, Artificial Sequence
  Marburg virus siRNA sense strand
ggauucuucaaucuaccuucc

SEQ ID NO: 36098 - RNA, 21 nt, Artificial Sequence
  Marburg virus siRNA sense strand
gauucuucaaucuaccuuccg

SEQ ID NO: 36099 - RNA, 21 nt, Artificial Sequence
  Marburg virus siRNA sense strand
auucuucaaucuaccuuccga

SEQ ID NO: 36100 - RNA, 21 nt, Artificial Sequence
  Marburg virus siRNA sense strand
uucuucaaucuaccuuccgac

SEQ ID NO: 36101 - RNA, 21 nt, Artificial Sequence
  Marburg virus siRNA sense strand
ucuucaaucuaccuuccgaca

SEQ ID NO: 36102 - RNA, 21 nt, Artificial Sequence
  Marburg virus siRNA sense strand
cuucaaucuaccuuccgacau

SEQ ID NO: 36103 - RNA, 21 nt, Artificial Sequence
  Marburg virus siRNA sense strand
uucaaucuaccuuccgacaug

SEQ ID NO: 36104 - RNA, 21 nt, Artificial Sequence
  Marburg virus siRNA sense strand
ucaaucuaccuuccgacauga

SEQ ID NO: 36105 - RNA, 21 nt, Artificial Sequence
  Marburg virus siRNA sense strand
caaucuaccuuccgacaugaa

SEQ ID NO: 36106 - RNA, 21 nt, Artificial Sequence
  Marburg virus siRNA sense strand
aaucuaccuuccgacaugaau

SEQ ID NO: 36107 - RNA, 21 nt, Artificial Sequence
  Marburg virus siRNA sense strand
aucuaccuuccgacaugaauu

SEQ ID NO: 36108 - RNA, 21 nt, Artificial Sequence
  Marburg virus siRNA sense strand
ucuaccuuccgacaugaauug

SEQ ID NO: 36109 - RNA, 21 nt, Artificial Sequence
  Marburg virus siRNA sense strand
cuaccuuccgacaugaauugg

SEQ ID NO: 36110 - RNA, 21 nt, Artificial Sequence
  Marburg virus siRNA sense strand
uaccuuccgacaugaauuggu

SEQ ID NO: 36111 - RNA, 21 nt, Artificial Sequence
  Marburg virus siRNA sense strand
accuuccgacaugaauuggua

SEQ ID NO: 36112 - RNA, 21 nt, Artificial Sequence
  Marburg virus siRNA sense strand
ccuuccgacaugaauugguac

SEQ ID NO: 36113 - RNA, 21 nt, Artificial Sequence
  Marburg virus siRNA sense strand
cuuccgacaugaauugguacu

SEQ ID NO: 36114 - RNA, 21 nt, Artificial Sequence
  Marburg virus siRNA sense strand
uuccgacaugaauugguacuc

SEQ ID NO: 36115 - RNA, 21 nt, Artificial Sequence
  Marburg virus siRNA sense strand
uccgacaugaauugguacuca

SEQ ID NO: 36116 - RNA, 21 nt, Artificial Sequence
  Marburg virus siRNA sense strand
ccgacaugaauugguacucac

SEQ ID NO: 36117 - RNA, 21 nt, Artificial Sequence
  Marburg virus siRNA sense strand
cgacaugaauugguacucacc

SEQ ID NO: 36118 - RNA, 21 nt, Artificial Sequence
  Marburg virus siRNA sense strand
gacaugaauugguacucaccc

SEQ ID NO: 36119 - RNA, 21 nt, Artificial Sequence
  Marburg virus siRNA sense strand
acaugaauugguacucacccg

SEQ ID NO: 36120 - RNA, 21 nt, Artificial Sequence
  Marburg virus siRNA sense strand
caugaauugguacucacccga

SEQ ID NO: 36121 - RNA, 21 nt, Artificial Sequence
  Marburg virus siRNA sense strand
augaauugguacucacccgac

SEQ ID NO: 36122 - RNA, 21 nt, Artificial Sequence
  Marburg virus siRNA sense strand
ugaauugguacucacccgacu

SEQ ID NO: 36123 - RNA, 21 nt, Artificial Sequence
  Marburg virus siRNA sense strand
gaauugguacucacccgacua

SEQ ID NO: 36124 - RNA, 21 nt, Artificial Sequence
  Marburg virus siRNA sense strand
aauugguacucacccgacuag

SEQ ID NO: 36125 - RNA, 21 nt, Artificial Sequence
  Marburg virus siRNA sense strand
auugguacucacccgacuagc

SEQ ID NO: 36126 - RNA, 21 nt, Artificial Sequence
  Marburg virus siRNA sense strand
uugguacucacccgacuagcc

SEQ ID NO: 36127 - RNA, 21 nt, Artificial Sequence
  Marburg virus siRNA sense strand
ugguacucacccgacuagccc

SEQ ID NO: 36128 - RNA, 21 nt, Artificial Sequence
  Marburg virus siRNA sense strand
gguacucacccgacuagccca

SEQ ID NO: 36129 - RNA, 21 nt, Artificial Sequence
  Marburg virus siRNA sense strand
guacucacccgacuagcccac

SEQ ID NO: 36130 - RNA, 21 nt, Artificial Sequence
  Marburg virus siRNA sense strand
uacucacccgacuagcccacc

SEQ ID NO: 36131 - RNA, 21 nt, Artificial Sequence
  Marburg virus siRNA sense strand
acucacccgacuagcccacca

SEQ ID NO: 36132 - RNA, 21 nt, Artificial Sequence
  Marburg virus siRNA sense strand
cucacccgacuagcccaccac

SEQ ID NO: 36133 - RNA, 21 nt, Artificial Sequence
  Marburg virus siRNA sense strand
ucacccgacuagcccaccaca

SEQ ID NO: 36134 - RNA, 21 nt, Artificial Sequence
  Marburg virus siRNA sense strand
cacccgacuagcccaccacau

SEQ ID NO: 36135 - RNA, 21 nt, Artificial Sequence
  Marburg virus siRNA sense strand
acccgacuagcccaccacaua

SEQ ID NO: 36136 - RNA, 21 nt, Artificial Sequence
  Marburg virus siRNA sense strand
cccgacuagcccaccacauac

SEQ ID NO: 36137 - RNA, 21 nt, Artificial Sequence
  Marburg virus siRNA sense strand
ccgacuagcccaccacauacc

SEQ ID NO: 36138 - RNA, 21 nt, Artificial Sequence
  Marburg virus siRNA sense strand
cgacuagcccaccacauaccg

SEQ ID NO: 36139 - RNA, 21 nt, Artificial Sequence
  Marburg virus siRNA sense strand
gacuagcccaccacauaccgu

SEQ ID NO: 36140 - RNA, 21 nt, Artificial Sequence
  Marburg virus siRNA sense strand
acuagcccaccacauaccguu

SEQ ID NO: 36141 - RNA, 21 nt, Artificial Sequence
  Marburg virus siRNA sense strand
cuagcccaccacauaccguua

SEQ ID NO: 36142 - RNA, 21 nt, Artificial Sequence
  Marburg virus siRNA sense strand
uagcccaccacauaccguuaa

SEQ ID NO: 36143 - RNA, 21 nt, Artificial Sequence
  Marburg virus siRNA sense strand
agcccaccacauaccguuaau

SEQ ID NO: 36144 - RNA, 21 nt, Artificial Sequence
  Marburg virus siRNA sense strand
gcccaccacauaccguuaauu

SEQ ID NO: 36145 - RNA, 21 nt, Artificial Sequence
  Marburg virus siRNA sense strand
cccaccacauaccguuaauuu

SEQ ID NO: 36146 - RNA, 21 nt, Artificial Sequence
  Marburg virus siRNA sense strand
ccaccacauaccguuaauuuc

SEQ ID NO: 36147 - RNA, 21 nt, Artificial Sequence
  Marburg virus siRNA sense strand
caccacauaccguuaauuucu

SEQ ID NO: 36148 - RNA, 21 nt, Artificial Sequence
  Marburg virus siRNA sense strand
accacauaccguuaauuucuu

SEQ ID NO: 36149 - RNA, 21 nt, Artificial Sequence
  Marburg virus siRNA sense strand
ccacauaccguuaauuucuuu

SEQ ID NO: 36150 - RNA, 21 nt, Artificial Sequence
  Marburg virus siRNA sense strand
cacauaccguuaauuucuuua

SEQ ID NO: 36151 - RNA, 21 nt, Artificial Sequence
  Marburg virus siRNA sense strand
acauaccguuaauuucuuuaa

SEQ ID NO: 36152 - RNA, 21 nt, Artificial Sequence
  Marburg virus siRNA sense strand
cauaccguuaauuucuuuaau

SEQ ID NO: 36153 - RNA, 21 nt, Artificial Sequence
  Marburg virus siRNA sense strand
auaccguuaauuucuuuaaug

SEQ ID NO: 36154 - RNA, 21 nt, Artificial Sequence
  Marburg virus siRNA sense strand
uaccguuaauuucuuuaaugu

SEQ ID NO: 36155 - RNA, 21 nt, Artificial Sequence
  Marburg virus siRNA sense strand
accguuaauuucuuuaauguu

SEQ ID NO: 36156 - RNA, 21 nt, Artificial Sequence
  Marburg virus siRNA sense strand
ccguuaauuucuuuaauguua

SEQ ID NO: 36157 - RNA, 21 nt, Artificial Sequence
  Marburg virus siRNA sense strand
cguuaauuucuuuaauguuag

SEQ ID NO: 36158 - RNA, 21 nt, Artificial Sequence
  Marburg virus siRNA sense strand
guuaauuucuuuaauguuagg

SEQ ID NO: 36159 - RNA, 21 nt, Artificial Sequence
  Marburg virus siRNA sense strand
uuaauuucuuuaauguuaggg

SEQ ID NO: 36160 - RNA, 21 nt, Artificial Sequence
  Marburg virus siRNA sense strand
uaauuucuuuaauguuagggg

SEQ ID NO: 36161 - RNA, 21 nt, Artificial Sequence
  Marburg virus siRNA sense strand
aauuucuuuaauguuaggggg

SEQ ID NO: 36162 - RNA, 21 nt, Artificial Sequence
  Marburg virus siRNA sense strand
auuucuuuaauguuagggggu

SEQ ID NO: 36163 - RNA, 21 nt, Artificial Sequence
  Marburg virus siRNA sense strand
uuucuuuaauguuaggggguu

SEQ ID NO: 36164 - RNA, 21 nt, Artificial Sequence
  Marburg virus siRNA sense strand
uucuuuaauguuaggggguuc

SEQ ID NO: 36165 - RNA, 21 nt, Artificial Sequence
  Marburg virus siRNA sense strand
ucuuuaauguuaggggguucu

SEQ ID NO: 36166 - RNA, 21 nt, Artificial Sequence
  Marburg virus siRNA sense strand
cuuuaauguuaggggguucug

SEQ ID NO: 36167 - RNA, 21 nt, Artificial Sequence
  Marburg virus siRNA sense strand
uuuaauguuaggggguucugc

SEQ ID NO: 36168 - RNA, 21 nt, Artificial Sequence
  Marburg virus siRNA sense strand
uuaauguuaggggguucugca

SEQ ID NO: 36169 - RNA, 21 nt, Artificial Sequence
  Marburg virus siRNA sense strand
uaauguuaggggguucugcag

SEQ ID NO: 36170 - RNA, 21 nt, Artificial Sequence
  Marburg virus siRNA sense strand
aauguuaggggguucugcagg

SEQ ID NO: 36171 - RNA, 21 nt, Artificial Sequence
  Marburg virus siRNA sense strand
auguuaggggguucugcagga

SEQ ID NO: 36172 - RNA, 21 nt, Artificial Sequence
  Marburg virus siRNA sense strand
uguuaggggguucugcaggag

SEQ ID NO: 36173 - RNA, 21 nt, Artificial Sequence
  Marburg virus siRNA sense strand
guuaggggguucugcaggaga

SEQ ID NO: 36174 - RNA, 21 nt, Artificial Sequence
  Marburg virus siRNA sense strand
uuaggggguucugcaggagag

SEQ ID NO: 36175 - RNA, 21 nt, Artificial Sequence
  Marburg virus siRNA sense strand
uaggggguucugcaggagaga

SEQ ID NO: 36176 - RNA, 21 nt, Artificial Sequence
  Marburg virus siRNA sense strand
aggggguucugcaggagagaa

SEQ ID NO: 36177 - RNA, 21 nt, Artificial Sequence
  Marburg virus siRNA sense strand
ggggguucugcaggagagaaa

SEQ ID NO: 36178 - RNA, 21 nt, Artificial Sequence
  Marburg virus siRNA sense strand
gggguucugcaggagagaaaa

SEQ ID NO: 36179 - RNA, 21 nt, Artificial Sequence
  Marburg virus siRNA sense strand
ggguucugcaggagagaaaag

SEQ ID NO: 36180 - RNA, 21 nt, Artificial Sequence
  Marburg virus siRNA sense strand
gguucugcaggagagaaaagu

SEQ ID NO: 36181 - RNA, 21 nt, Artificial Sequence
  Marburg virus siRNA sense strand
guucugcaggagagaaaaguu

SEQ ID NO: 36182 - RNA, 21 nt, Artificial Sequence
  Marburg virus siRNA sense strand
uucugcaggagagaaaaguuc

SEQ ID NO: 36183 - RNA, 21 nt, Artificial Sequence
  Marburg virus siRNA sense strand
ucugcaggagagaaaaguuca

SEQ ID NO: 36184 - RNA, 21 nt, Artificial Sequence
  Marburg virus siRNA sense strand
cugcaggagagaaaaguucau

SEQ ID NO: 36185 - RNA, 21 nt, Artificial Sequence
  Marburg virus siRNA sense strand
ugcaggagagaaaaguucauc

SEQ ID NO: 36186 - RNA, 21 nt, Artificial Sequence
  Marburg virus siRNA sense strand
gcaggagagaaaaguucauca

SEQ ID NO: 36187 - RNA, 21 nt, Artificial Sequence
  Marburg virus siRNA sense strand
caggagagaaaaguucaucag

SEQ ID NO: 36188 - RNA, 21 nt, Artificial Sequence
  Marburg virus siRNA sense strand
aggagagaaaaguucaucaga

SEQ ID NO: 36189 - RNA, 21 nt, Artificial Sequence
  Marburg virus siRNA sense strand
ggagagaaaaguucaucagau

SEQ ID NO: 36190 - RNA, 21 nt, Artificial Sequence
  Marburg virus siRNA sense strand
gagagaaaaguucaucagaug

SEQ ID NO: 36191 - RNA, 21 nt, Artificial Sequence
  Marburg virus siRNA sense strand
agagaaaaguucaucagaugc

SEQ ID NO: 36192 - RNA, 21 nt, Artificial Sequence
  Marburg virus siRNA sense strand
gagaaaaguucaucagaugcu

SEQ ID NO: 36193 - RNA, 21 nt, Artificial Sequence
  Marburg virus siRNA sense strand
agaaaaguucaucagaugcug

SEQ ID NO: 36194 - RNA, 21 nt, Artificial Sequence
  Marburg virus siRNA sense strand
gaaaaguucaucagaugcugu

SEQ ID NO: 36195 - RNA, 21 nt, Artificial Sequence
  Marburg virus siRNA sense strand
aaaaguucaucagaugcuguu

SEQ ID NO: 36196 - RNA, 21 nt, Artificial Sequence
  Marburg virus siRNA sense strand
aaaguucaucagaugcuguuc

SEQ ID NO: 36197 - RNA, 21 nt, Artificial Sequence
  Marburg virus siRNA sense strand
aaguucaucagaugcuguucg

SEQ ID NO: 36198 - RNA, 21 nt, Artificial Sequence
  Marburg virus siRNA sense strand
aguucaucagaugcuguucgg

SEQ ID NO: 36199 - RNA, 21 nt, Artificial Sequence
  Marburg virus siRNA sense strand
guucaucagaugcuguucggc

SEQ ID NO: 36200 - RNA, 21 nt, Artificial Sequence
  Marburg virus siRNA sense strand
uucaucagaugcuguucggcu

SEQ ID NO: 36201 - RNA, 21 nt, Artificial Sequence
  Marburg virus siRNA sense strand
ucaucagaugcuguucggcua

SEQ ID NO: 36202 - RNA, 21 nt, Artificial Sequence
  Marburg virus siRNA sense strand
caucagaugcuguucggcuau

SEQ ID NO: 36203 - RNA, 21 nt, Artificial Sequence
  Marburg virus siRNA sense strand
aucagaugcuguucggcuauu

SEQ ID NO: 36204 - RNA, 21 nt, Artificial Sequence
  Marburg virus siRNA sense strand
ucagaugcuguucggcuauuu

SEQ ID NO: 36205 - RNA, 21 nt, Artificial Sequence
  Marburg virus siRNA sense strand
cagaugcuguucggcuauuuc

SEQ ID NO: 36206 - RNA, 21 nt, Artificial Sequence
  Marburg virus siRNA sense strand
agaugcuguucggcuauuucu

SEQ ID NO: 36207 - RNA, 21 nt, Artificial Sequence
  Marburg virus siRNA sense strand
gaugcuguucggcuauuucuu

SEQ ID NO: 36208 - RNA, 21 nt, Artificial Sequence
  Marburg virus siRNA sense strand
augcuguucggcuauuucuua

SEQ ID NO: 36209 - RNA, 21 nt, Artificial Sequence
  Marburg virus siRNA sense strand
ugcuguucggcuauuucuuac

SEQ ID NO: 36210 - RNA, 21 nt, Artificial Sequence
  Marburg virus siRNA sense strand
gcuguucggcuauuucuuaca

SEQ ID NO: 36211 - RNA, 21 nt, Artificial Sequence
  Marburg virus siRNA sense strand
cuguucggcuauuucuuacag

SEQ ID NO: 36212 - RNA, 21 nt, Artificial Sequence
  Marburg virus siRNA sense strand
uguucggcuauuucuuacagc

SEQ ID NO: 36213 - RNA, 21 nt, Artificial Sequence
  Marburg virus siRNA sense strand
guucggcuauuucuuacagca

SEQ ID NO: 36214 - RNA, 21 nt, Artificial Sequence
  Marburg virus siRNA sense strand
uucggcuauuucuuacagcaa

SEQ ID NO: 36215 - RNA, 21 nt, Artificial Sequence
  Marburg virus siRNA sense strand
ucggcuauuucuuacagcaag

SEQ ID NO: 36216 - RNA, 21 nt, Artificial Sequence
  Marburg virus siRNA sense strand
cggcuauuucuuacagcaagu

SEQ ID NO: 36217 - RNA, 21 nt, Artificial Sequence
  Marburg virus siRNA sense strand
ggcuauuucuuacagcaaguu

SEQ ID NO: 36218 - RNA, 21 nt, Artificial Sequence
  Marburg virus siRNA sense strand
gcuauuucuuacagcaaguua

SEQ ID NO: 36219 - RNA, 21 nt, Artificial Sequence
  Marburg virus siRNA sense strand
cuauuucuuacagcaaguuac

SEQ ID NO: 36220 - RNA, 21 nt, Artificial Sequence
  Marburg virus siRNA sense strand
uauuucuuacagcaaguuacc

SEQ ID NO: 36221 - RNA, 21 nt, Artificial Sequence
  Marburg virus siRNA sense strand
auuucuuacagcaaguuacca

SEQ ID NO: 36222 - RNA, 21 nt, Artificial Sequence
  Marburg virus siRNA sense strand
uuucuuacagcaaguuaccag

SEQ ID NO: 36223 - RNA, 21 nt, Artificial Sequence
  Marburg virus siRNA sense strand
uucuuacagcaaguuaccaga

SEQ ID NO: 36224 - RNA, 21 nt, Artificial Sequence
  Marburg virus siRNA sense strand
ucuuacagcaaguuaccagaa

SEQ ID NO: 36225 - RNA, 21 nt, Artificial Sequence
  Marburg virus siRNA sense strand
cuuacagcaaguuaccagaau

SEQ ID NO: 36226 - RNA, 21 nt, Artificial Sequence
  Marburg virus siRNA sense strand
uuacagcaaguuaccagaauu

SEQ ID NO: 36227 - RNA, 21 nt, Artificial Sequence
  Marburg virus siRNA sense strand
uacagcaaguuaccagaauuu

SEQ ID NO: 36228 - RNA, 21 nt, Artificial Sequence
  Marburg virus siRNA sense strand
acagcaaguuaccagaauuuc

SEQ ID NO: 36229 - RNA, 21 nt, Artificial Sequence
  Marburg virus siRNA sense strand
cagcaaguuaccagaauuuca

SEQ ID NO: 36230 - RNA, 21 nt, Artificial Sequence
  Marburg virus siRNA sense strand
agcaaguuaccagaauuucau

SEQ ID NO: 36231 - RNA, 21 nt, Artificial Sequence
  Marburg virus siRNA sense strand
gcaaguuaccagaauuucauc

SEQ ID NO: 36232 - RNA, 21 nt, Artificial Sequence
  Marburg virus siRNA sense strand
caaguuaccagaauuucauca

SEQ ID NO: 36233 - RNA, 21 nt, Artificial Sequence
  Marburg virus siRNA sense strand
aaguuaccagaauuucaucaa

SEQ ID NO: 36234 - RNA, 21 nt, Artificial Sequence
  Marburg virus siRNA sense strand
aguuaccagaauuucaucaac

SEQ ID NO: 36235 - RNA, 21 nt, Artificial Sequence
  Marburg virus siRNA sense strand
guuaccagaauuucaucaaca

SEQ ID NO: 36236 - RNA, 21 nt, Artificial Sequence
  Marburg virus siRNA sense strand
uuaccagaauuucaucaacaa

SEQ ID NO: 36237 - RNA, 21 nt, Artificial Sequence
  Marburg virus siRNA sense strand
uaccagaauuucaucaacaac

SEQ ID NO: 36238 - RNA, 21 nt, Artificial Sequence
  Marburg virus siRNA sense strand
accagaauuucaucaacaacu

SEQ ID NO: 36239 - RNA, 21 nt, Artificial Sequence
  Marburg virus siRNA sense strand
ccagaauuucaucaacaacuu

SEQ ID NO: 36240 - RNA, 21 nt, Artificial Sequence
  Marburg virus siRNA sense strand
cagaauuucaucaacaacuuc

SEQ ID NO: 36241 - RNA, 21 nt, Artificial Sequence
  Marburg virus siRNA sense strand
agaauuucaucaacaacuuca

SEQ ID NO: 36242 - RNA, 21 nt, Artificial Sequence
  Marburg virus siRNA sense strand
gaauuucaucaacaacuucag

SEQ ID NO: 36243 - RNA, 21 nt, Artificial Sequence
  Marburg virus siRNA sense strand
aauuucaucaacaacuucagu

SEQ ID NO: 36244 - RNA, 21 nt, Artificial Sequence
  Marburg virus siRNA sense strand
auuucaucaacaacuucaguu

SEQ ID NO: 36245 - RNA, 21 nt, Artificial Sequence
  Marburg virus siRNA sense strand
uuucaucaacaacuucaguug

SEQ ID NO: 36246 - RNA, 21 nt, Artificial Sequence
  Marburg virus siRNA sense strand
uucaucaacaacuucaguugu

SEQ ID NO: 36247 - RNA, 21 nt, Artificial Sequence
  Marburg virus siRNA sense strand
ucaucaacaacuucaguuguu

SEQ ID NO: 36248 - RNA, 21 nt, Artificial Sequence
  Marburg virus siRNA sense strand
caucaacaacuucaguuguuu

SEQ ID NO: 36249 - RNA, 21 nt, Artificial Sequence
  Marburg virus siRNA sense strand
aucaacaacuucaguuguuug

SEQ ID NO: 36250 - RNA, 21 nt, Artificial Sequence
  Marburg virus siRNA sense strand
ucaacaacuucaguuguuuga

SEQ ID NO: 36251 - RNA, 21 nt, Artificial Sequence
  Marburg virus siRNA sense strand
caacaacuucaguuguuugau

SEQ ID NO: 36252 - RNA, 21 nt, Artificial Sequence
  Marburg virus siRNA sense strand
aacaacuucaguuguuugaug

SEQ ID NO: 36253 - RNA, 21 nt, Artificial Sequence
  Marburg virus siRNA sense strand
acaacuucaguuguuugauga

SEQ ID NO: 36254 - RNA, 21 nt, Artificial Sequence
  Marburg virus siRNA sense strand
caacuucaguuguuugaugaa

SEQ ID NO: 36255 - RNA, 21 nt, Artificial Sequence
  Marburg virus siRNA sense strand
aacuucaguuguuugaugaaa

SEQ ID NO: 36256 - RNA, 21 nt, Artificial Sequence
  Marburg virus siRNA sense strand
acuucaguuguuugaugaaaa

SEQ ID NO: 36257 - RNA, 21 nt, Artificial Sequence
  Marburg virus siRNA sense strand
cuucaguuguuugaugaaaaa

SEQ ID NO: 36258 - RNA, 21 nt, Artificial Sequence
  Marburg virus siRNA sense strand
uucaguuguuugaugaaaaag

SEQ ID NO: 36259 - RNA, 21 nt, Artificial Sequence
  Marburg virus siRNA sense strand
ucaguuguuugaugaaaaagg

SEQ ID NO: 36260 - RNA, 21 nt, Artificial Sequence
  Marburg virus siRNA sense strand
caguuguuugaugaaaaaggg

SEQ ID NO: 36261 - RNA, 21 nt, Artificial Sequence
  Marburg virus siRNA sense strand
aguuguuugaugaaaaagggc

SEQ ID NO: 36262 - RNA, 21 nt, Artificial Sequence
  Marburg virus siRNA sense strand
guuguuugaugaaaaagggcc

SEQ ID NO: 36263 - RNA, 21 nt, Artificial Sequence
  Marburg virus siRNA sense strand
uuguuugaugaaaaagggcca

SEQ ID NO: 36264 - RNA, 21 nt, Artificial Sequence
  Marburg virus siRNA sense strand
uguuugaugaaaaagggccag

SEQ ID NO: 36265 - RNA, 21 nt, Artificial Sequence
  Marburg virus siRNA sense strand
guuugaugaaaaagggccagu

SEQ ID NO: 36266 - RNA, 21 nt, Artificial Sequence
  Marburg virus siRNA sense strand
uuugaugaaaaagggccaguc

SEQ ID NO: 36267 - RNA, 21 nt, Artificial Sequence
  Marburg virus siRNA sense strand
uugaugaaaaagggccaguca

SEQ ID NO: 36268 - RNA, 21 nt, Artificial Sequence
  Marburg virus siRNA sense strand
ugaugaaaaagggccagucau

SEQ ID NO: 36269 - RNA, 21 nt, Artificial Sequence
  Marburg virus siRNA sense strand
gaugaaaaagggccagucauc

SEQ ID NO: 36270 - RNA, 21 nt, Artificial Sequence
  Marburg virus siRNA sense strand
augaaaaagggccagucauca

SEQ ID NO: 36271 - RNA, 21 nt, Artificial Sequence
  Marburg virus siRNA sense strand
ugaaaaagggccagucaucac

SEQ ID NO: 36272 - RNA, 21 nt, Artificial Sequence
  Marburg virus siRNA sense strand
gaaaaagggccagucaucacu

SEQ ID NO: 36273 - RNA, 21 nt, Artificial Sequence
  Marburg virus siRNA sense strand
aaaaagggccagucaucacua

SEQ ID NO: 36274 - RNA, 21 nt, Artificial Sequence
  Marburg virus siRNA sense strand
aaaagggccagucaucacuac

SEQ ID NO: 36275 - RNA, 21 nt, Artificial Sequence
  Marburg virus siRNA sense strand
aaagggccagucaucacuacc

SEQ ID NO: 36276 - RNA, 21 nt, Artificial Sequence
  Marburg virus siRNA sense strand
aagggccagucaucacuaccg

SEQ ID NO: 36277 - RNA, 21 nt, Artificial Sequence
  Marburg virus siRNA sense strand
agggccagucaucacuaccgg

SEQ ID NO: 36278 - RNA, 21 nt, Artificial Sequence
  Marburg virus siRNA sense strand
gggccagucaucacuaccggu

SEQ ID NO: 36279 - RNA, 21 nt, Artificial Sequence
  Marburg virus siRNA sense strand
ggccagucaucacuaccgguu

SEQ ID NO: 36280 - RNA, 21 nt, Artificial Sequence
  Marburg virus siRNA sense strand
gccagucaucacuaccgguuu

SEQ ID NO: 36281 - RNA, 21 nt, Artificial Sequence
  Marburg virus siRNA sense strand
ccagucaucacuaccgguuug

SEQ ID NO: 36282 - RNA, 21 nt, Artificial Sequence
  Marburg virus siRNA sense strand
cagucaucacuaccgguuugg

SEQ ID NO: 36283 - RNA, 21 nt, Artificial Sequence
  Marburg virus siRNA sense strand
agucaucacuaccgguuuggc

SEQ ID NO: 36284 - RNA, 21 nt, Artificial Sequence
  Marburg virus siRNA sense strand
gucaucacuaccgguuuggcu

SEQ ID NO: 36285 - RNA, 21 nt, Artificial Sequence
  Marburg virus siRNA sense strand
ucaucacuaccgguuuggcuu

SEQ ID NO: 36286 - RNA, 21 nt, Artificial Sequence
  Marburg virus siRNA sense strand
caucacuaccgguuuggcuuu

SEQ ID NO: 36287 - RNA, 21 nt, Artificial Sequence
  Marburg virus siRNA sense strand
aucacuaccgguuuggcuuua

SEQ ID NO: 36288 - RNA, 21 nt, Artificial Sequence
  Marburg virus siRNA sense strand
ucacuaccgguuuggcuuuac

SEQ ID NO: 36289 - RNA, 21 nt, Artificial Sequence
  Marburg virus siRNA sense strand
cacuaccgguuuggcuuuacu

SEQ ID NO: 36290 - RNA, 21 nt, Artificial Sequence
  Marburg virus siRNA sense strand
acuaccgguuuggcuuuacuu

SEQ ID NO: 36291 - RNA, 21 nt, Artificial Sequence
  Marburg virus siRNA sense strand
cuaccgguuuggcuuuacuuu

SEQ ID NO: 36292 - RNA, 21 nt, Artificial Sequence
  Marburg virus siRNA sense strand
uaccgguuuggcuuuacuuuc

SEQ ID NO: 36293 - RNA, 21 nt, Artificial Sequence
  Marburg virus siRNA sense strand
accgguuuggcuuuacuuucc

SEQ ID NO: 36294 - RNA, 21 nt, Artificial Sequence
  Marburg virus siRNA sense strand
ccgguuuggcuuuacuuuccu

SEQ ID NO: 36295 - RNA, 21 nt, Artificial Sequence
  Marburg virus siRNA sense strand
cgguuuggcuuuacuuuccua

SEQ ID NO: 36296 - RNA, 21 nt, Artificial Sequence
  Marburg virus siRNA sense strand
gguuuggcuuuacuuuccuag

SEQ ID NO: 36297 - RNA, 21 nt, Artificial Sequence
  Marburg virus siRNA sense strand
guuuggcuuuacuuuccuagu

SEQ ID NO: 36298 - RNA, 21 nt, Artificial Sequence
  Marburg virus siRNA sense strand
uuuggcuuuacuuuccuagug

SEQ ID NO: 36299 - RNA, 21 nt, Artificial Sequence
  Marburg virus siRNA sense strand
uuggcuuuacuuuccuaguga

SEQ ID NO: 36300 - RNA, 21 nt, Artificial Sequence
  Marburg virus siRNA sense strand
uggcuuuacuuuccuagugaa

SEQ ID NO: 36301 - RNA, 21 nt, Artificial Sequence
  Marburg virus siRNA sense strand
ggcuuuacuuuccuagugaag

SEQ ID NO: 36302 - RNA, 21 nt, Artificial Sequence
  Marburg virus siRNA sense strand
gcuuuacuuuccuagugaagg

SEQ ID NO: 36303 - RNA, 21 nt, Artificial Sequence
  Marburg virus siRNA sense strand
cuuuacuuuccuagugaaggg

SEQ ID NO: 36304 - RNA, 21 nt, Artificial Sequence
  Marburg virus siRNA sense strand
uuuacuuuccuagugaagggc

SEQ ID NO: 36305 - RNA, 21 nt, Artificial Sequence
  Marburg virus siRNA sense strand
uuacuuuccuagugaagggca

SEQ ID NO: 36306 - RNA, 21 nt, Artificial Sequence
  Marburg virus siRNA sense strand
uacuuuccuagugaagggcaa

SEQ ID NO: 36307 - RNA, 21 nt, Artificial Sequence
  Marburg virus siRNA sense strand
acuuuccuagugaagggcaac

SEQ ID NO: 36308 - RNA, 21 nt, Artificial Sequence
  Marburg virus siRNA sense strand
cuuuccuagugaagggcaaca

SEQ ID NO: 36309 - RNA, 21 nt, Artificial Sequence
  Marburg virus siRNA sense strand
uuuccuagugaagggcaacaa

SEQ ID NO: 36310 - RNA, 21 nt, Artificial Sequence
  Marburg virus siRNA sense strand
uuccuagugaagggcaacaau

SEQ ID NO: 36311 - RNA, 21 nt, Artificial Sequence
  Marburg virus siRNA sense strand
uccuagugaagggcaacaauu

SEQ ID NO: 36312 - RNA, 21 nt, Artificial Sequence
  Marburg virus siRNA sense strand
ccuagugaagggcaacaauua

SEQ ID NO: 36313 - RNA, 21 nt, Artificial Sequence
  Marburg virus siRNA sense strand
cuagugaagggcaacaauuaa

SEQ ID NO: 36314 - RNA, 21 nt, Artificial Sequence
  Marburg virus siRNA sense strand
uagugaagggcaacaauuaaa

SEQ ID NO: 36315 - RNA, 21 nt, Artificial Sequence
  Marburg virus siRNA sense strand
agugaagggcaacaauuaaaa

SEQ ID NO: 36316 - RNA, 21 nt, Artificial Sequence
  Marburg virus siRNA sense strand
gugaagggcaacaauuaaaac

SEQ ID NO: 36317 - RNA, 21 nt, Artificial Sequence
  Marburg virus siRNA sense strand
ugaagggcaacaauuaaaacc

SEQ ID NO: 36318 - RNA, 21 nt, Artificial Sequence
  Marburg virus siRNA sense strand
gaagggcaacaauuaaaaccu

SEQ ID NO: 36319 - RNA, 21 nt, Artificial Sequence
  Marburg virus siRNA sense strand
aagggcaacaauuaaaaccua

SEQ ID NO: 36320 - RNA, 21 nt, Artificial Sequence
  Marburg virus siRNA sense strand
agggcaacaauuaaaaccuau

SEQ ID NO: 36321 - RNA, 21 nt, Artificial Sequence
  Marburg virus siRNA sense strand
gggcaacaauuaaaaccuaua

SEQ ID NO: 36322 - RNA, 21 nt, Artificial Sequence
  Marburg virus siRNA sense strand
ggcaacaauuaaaaccuauau

SEQ ID NO: 36323 - RNA, 21 nt, Artificial Sequence
  Marburg virus siRNA sense strand
gcaacaauuaaaaccuauauu

SEQ ID NO: 36324 - RNA, 21 nt, Artificial Sequence
  Marburg virus siRNA sense strand
caacaauuaaaaccuauauua

SEQ ID NO: 36325 - RNA, 21 nt, Artificial Sequence
  Marburg virus siRNA sense strand
aacaauuaaaaccuauauuaa

SEQ ID NO: 36326 - RNA, 21 nt, Artificial Sequence
  Marburg virus siRNA sense strand
acaauuaaaaccuauauuaaa

SEQ ID NO: 36327 - RNA, 21 nt, Artificial Sequence
  Marburg virus siRNA sense strand
caauuaaaaccuauauuaaaa

SEQ ID NO: 36328 - RNA, 21 nt, Artificial Sequence
  Marburg virus siRNA sense strand
aauuaaaaccuauauuaaaaa

SEQ ID NO: 36329 - RNA, 21 nt, Artificial Sequence
  Marburg virus siRNA sense strand
auuaaaaccuauauuaaaaau

SEQ ID NO: 36330 - RNA, 21 nt, Artificial Sequence
  Marburg virus siRNA sense strand
uuaaaaccuauauuaaaaauc

SEQ ID NO: 36331 - RNA, 21 nt, Artificial Sequence
  Marburg virus siRNA sense strand
uaaaaccuauauuaaaaaucu

SEQ ID NO: 36332 - RNA, 21 nt, Artificial Sequence
  Marburg virus siRNA sense strand
aaaaccuauauuaaaaaucuu

SEQ ID NO: 36333 - RNA, 21 nt, Artificial Sequence
  Marburg virus siRNA sense strand
aaaccuauauuaaaaaucuua

SEQ ID NO: 36334 - RNA, 21 nt, Artificial Sequence
  Marburg virus siRNA sense strand
aaccuauauuaaaaaucuuac

SEQ ID NO: 36335 - RNA, 21 nt, Artificial Sequence
  Marburg virus siRNA sense strand
accuauauuaaaaaucuuaca

SEQ ID NO: 36336 - RNA, 21 nt, Artificial Sequence
  Marburg virus siRNA sense strand
ccuauauuaaaaaucuuacag

SEQ ID NO: 36337 - RNA, 21 nt, Artificial Sequence
  Marburg virus siRNA sense strand
cuauauuaaaaaucuuacaga

SEQ ID NO: 36338 - RNA, 21 nt, Artificial Sequence
  Marburg virus siRNA sense strand
uauauuaaaaaucuuacagag

SEQ ID NO: 36339 - RNA, 21 nt, Artificial Sequence
  Marburg virus siRNA sense strand
auauuaaaaaucuuacagaga

SEQ ID NO: 36340 - RNA, 21 nt, Artificial Sequence
  Marburg virus siRNA sense strand
uauuaaaaaucuuacagagau

SEQ ID NO: 36341 - RNA, 21 nt, Artificial Sequence
  Marburg virus siRNA sense strand
auuaaaaaucuuacagagauu

SEQ ID NO: 36342 - RNA, 21 nt, Artificial Sequence
  Marburg virus siRNA sense strand
uuaaaaaucuuacagagauua

SEQ ID NO: 36343 - RNA, 21 nt, Artificial Sequence
  Marburg virus siRNA sense strand
uaaaaaucuuacagagauuau

SEQ ID NO: 36344 - RNA, 21 nt, Artificial Sequence
  Marburg virus siRNA sense strand
aaaaaucuuacagagauuauc

SEQ ID NO: 36345 - RNA, 21 nt, Artificial Sequence
  Marburg virus siRNA sense strand
aaaaucuuacagagauuauca

SEQ ID NO: 36346 - RNA, 21 nt, Artificial Sequence
  Marburg virus siRNA sense strand
aaaucuuacagagauuaucag

SEQ ID NO: 36347 - RNA, 21 nt, Artificial Sequence
  Marburg virus siRNA sense strand
aaucuuacagagauuaucaga

SEQ ID NO: 36348 - RNA, 21 nt, Artificial Sequence
  Marburg virus siRNA sense strand
aucuuacagagauuaucagac

SEQ ID NO: 36349 - RNA, 21 nt, Artificial Sequence
  Marburg virus siRNA sense strand
ucuuacagagauuaucagacu

SEQ ID NO: 36350 - RNA, 21 nt, Artificial Sequence
  Marburg virus siRNA sense strand
cuuacagagauuaucagacuu

SEQ ID NO: 36351 - RNA, 21 nt, Artificial Sequence
  Marburg virus siRNA sense strand
uuacagagauuaucagacuug

SEQ ID NO: 36352 - RNA, 21 nt, Artificial Sequence
  Marburg virus siRNA sense strand
uacagagauuaucagacuugu

SEQ ID NO: 36353 - RNA, 21 nt, Artificial Sequence
  Marburg virus siRNA sense strand
acagagauuaucagacuuguu

SEQ ID NO: 36354 - RNA, 21 nt, Artificial Sequence
  Marburg virus siRNA sense strand
cagagauuaucagacuuguua

SEQ ID NO: 36355 - RNA, 21 nt, Artificial Sequence
  Marburg virus siRNA sense strand
agagauuaucagacuuguuau

SEQ ID NO: 36356 - RNA, 21 nt, Artificial Sequence
  Marburg virus siRNA sense strand
gagauuaucagacuuguuauc

SEQ ID NO: 36357 - RNA, 21 nt, Artificial Sequence
  Marburg virus siRNA sense strand
agauuaucagacuuguuauca

SEQ ID NO: 36358 - RNA, 21 nt, Artificial Sequence
  Marburg virus siRNA sense strand
gauuaucagacuuguuaucac

SEQ ID NO: 36359 - RNA, 21 nt, Artificial Sequence
  Marburg virus siRNA sense strand
auuaucagacuuguuaucacc

SEQ ID NO: 36360 - RNA, 21 nt, Artificial Sequence
  Marburg virus siRNA sense strand
uuaucagacuuguuaucaccu

SEQ ID NO: 36361 - RNA, 21 nt, Artificial Sequence
  Marburg virus siRNA sense strand
uaucagacuuguuaucaccug

SEQ ID NO: 36362 - RNA, 21 nt, Artificial Sequence
  Marburg virus siRNA sense strand
aucagacuuguuaucaccuga

SEQ ID NO: 36363 - RNA, 21 nt, Artificial Sequence
  Marburg virus siRNA sense strand
ucagacuuguuaucaccugac

SEQ ID NO: 36364 - RNA, 21 nt, Artificial Sequence
  Marburg virus siRNA sense strand
cagacuuguuaucaccugaca

SEQ ID NO: 36365 - RNA, 21 nt, Artificial Sequence
  Marburg virus siRNA sense strand
agacuuguuaucaccugacaa

SEQ ID NO: 36366 - RNA, 21 nt, Artificial Sequence
  Marburg virus siRNA sense strand
gacuuguuaucaccugacaaa

SEQ ID NO: 36367 - RNA, 21 nt, Artificial Sequence
  Marburg virus siRNA sense strand
acuuguuaucaccugacaaag

SEQ ID NO: 36368 - RNA, 21 nt, Artificial Sequence
  Marburg virus siRNA sense strand
cuuguuaucaccugacaaagu

SEQ ID NO: 36369 - RNA, 21 nt, Artificial Sequence
  Marburg virus siRNA sense strand
uuguuaucaccugacaaaguu

SEQ ID NO: 36370 - RNA, 21 nt, Artificial Sequence
  Marburg virus siRNA sense strand
uguuaucaccugacaaaguuc

SEQ ID NO: 36371 - RNA, 21 nt, Artificial Sequence
  Marburg virus siRNA sense strand
guuaucaccugacaaaguuca

SEQ ID NO: 36372 - RNA, 21 nt, Artificial Sequence
  Marburg virus siRNA sense strand
uuaucaccugacaaaguucaa

SEQ ID NO: 36373 - RNA, 21 nt, Artificial Sequence
  Marburg virus siRNA sense strand
uaucaccugacaaaguucaaa

SEQ ID NO: 36374 - RNA, 21 nt, Artificial Sequence
  Marburg virus siRNA sense strand
aucaccugacaaaguucaaaa

SEQ ID NO: 36375 - RNA, 21 nt, Artificial Sequence
  Marburg virus siRNA sense strand
ucaccugacaaaguucaaaag

SEQ ID NO: 36376 - RNA, 21 nt, Artificial Sequence
  Marburg virus siRNA sense strand
caccugacaaaguucaaaagc

SEQ ID NO: 36377 - RNA, 21 nt, Artificial Sequence
  Marburg virus siRNA sense strand
accugacaaaguucaaaagca

SEQ ID NO: 36378 - RNA, 21 nt, Artificial Sequence
  Marburg virus siRNA sense strand
ccugacaaaguucaaaagcau

SEQ ID NO: 36379 - RNA, 21 nt, Artificial Sequence
  Marburg virus siRNA sense strand
cugacaaaguucaaaagcauc

SEQ ID NO: 36380 - RNA, 21 nt, Artificial Sequence
  Marburg virus siRNA sense strand
ugacaaaguucaaaagcauca

SEQ ID NO: 36381 - RNA, 21 nt, Artificial Sequence
  Marburg virus siRNA sense strand
gacaaaguucaaaagcaucaa

SEQ ID NO: 36382 - RNA, 21 nt, Artificial Sequence
  Marburg virus siRNA sense strand
acaaaguucaaaagcaucaaa

SEQ ID NO: 36383 - RNA, 21 nt, Artificial Sequence
  Marburg virus siRNA sense strand
caaaguucaaaagcaucaaau

SEQ ID NO: 36384 - RNA, 21 nt, Artificial Sequence
  Marburg virus siRNA sense strand
aaaguucaaaagcaucaaauc

SEQ ID NO: 36385 - RNA, 21 nt, Artificial Sequence
  Marburg virus siRNA sense strand
aaguucaaaagcaucaaaucu

SEQ ID NO: 36386 - RNA, 21 nt, Artificial Sequence
  Marburg virus siRNA sense strand
aguucaaaagcaucaaaucuu

SEQ ID NO: 36387 - RNA, 21 nt, Artificial Sequence
  Marburg virus siRNA sense strand
guucaaaagcaucaaaucuua

SEQ ID NO: 36388 - RNA, 21 nt, Artificial Sequence
  Marburg virus siRNA sense strand
uucaaaagcaucaaaucuuag

SEQ ID NO: 36389 - RNA, 21 nt, Artificial Sequence
  Marburg virus siRNA sense strand
ucaaaagcaucaaaucuuagc

SEQ ID NO: 36390 - RNA, 21 nt, Artificial Sequence
  Marburg virus siRNA sense strand
caaaagcaucaaaucuuagcu

SEQ ID NO: 36391 - RNA, 21 nt, Artificial Sequence
  Marburg virus siRNA sense strand
aaaagcaucaaaucuuagcug

SEQ ID NO: 36392 - RNA, 21 nt, Artificial Sequence
  Marburg virus siRNA sense strand
aaagcaucaaaucuuagcuga

SEQ ID NO: 36393 - RNA, 21 nt, Artificial Sequence
  Marburg virus siRNA sense strand
aagcaucaaaucuuagcugac

SEQ ID NO: 36394 - RNA, 21 nt, Artificial Sequence
  Marburg virus siRNA sense strand
agcaucaaaucuuagcugaca

SEQ ID NO: 36395 - RNA, 21 nt, Artificial Sequence
  Marburg virus siRNA sense strand
gcaucaaaucuuagcugacac

SEQ ID NO: 36396 - RNA, 21 nt, Artificial Sequence
  Marburg virus siRNA sense strand
caucaaaucuuagcugacacc

SEQ ID NO: 36397 - RNA, 21 nt, Artificial Sequence
  Marburg virus siRNA sense strand
aucaaaucuuagcugacaccu

SEQ ID NO: 36398 - RNA, 21 nt, Artificial Sequence
  Marburg virus siRNA sense strand
ucaaaucuuagcugacaccug

SEQ ID NO: 36399 - RNA, 21 nt, Artificial Sequence
  Marburg virus siRNA sense strand
caaaucuuagcugacaccugu

SEQ ID NO: 36400 - RNA, 21 nt, Artificial Sequence
  Marburg virus siRNA sense strand
aaaucuuagcugacaccuguu

SEQ ID NO: 36401 - RNA, 21 nt, Artificial Sequence
  Marburg virus siRNA sense strand
aaucuuagcugacaccuguug

SEQ ID NO: 36402 - RNA, 21 nt, Artificial Sequence
  Marburg virus siRNA sense strand
aucuuagcugacaccuguugu

SEQ ID NO: 36403 - RNA, 21 nt, Artificial Sequence
  Marburg virus siRNA sense strand
ucuuagcugacaccuguuguc

SEQ ID NO: 36404 - RNA, 21 nt, Artificial Sequence
  Marburg virus siRNA sense strand
cuuagcugacaccuguugucc

SEQ ID NO: 36405 - RNA, 21 nt, Artificial Sequence
  Marburg virus siRNA sense strand
uuagcugacaccuguugucca

SEQ ID NO: 36406 - RNA, 21 nt, Artificial Sequence
  Marburg virus siRNA sense strand
uagcugacaccuguuguccaa

SEQ ID NO: 36407 - RNA, 21 nt, Artificial Sequence
  Marburg virus siRNA sense strand
agcugacaccuguuguccaau

SEQ ID NO: 36408 - RNA, 21 nt, Artificial Sequence
  Marburg virus siRNA sense strand
gcugacaccuguuguccaauu

SEQ ID NO: 36409 - RNA, 21 nt, Artificial Sequence
  Marburg virus siRNA sense strand
cugacaccuguuguccaauug

SEQ ID NO: 36410 - RNA, 21 nt, Artificial Sequence
  Marburg virus siRNA sense strand
ugacaccuguuguccaauuga

SEQ ID NO: 36411 - RNA, 21 nt, Artificial Sequence
  Marburg virus siRNA sense strand
gacaccuguuguccaauugac

SEQ ID NO: 36412 - RNA, 21 nt, Artificial Sequence
  Marburg virus siRNA sense strand
acaccuguuguccaauugaca

SEQ ID NO: 36413 - RNA, 21 nt, Artificial Sequence
  Marburg virus siRNA sense strand
caccuguuguccaauugacag

SEQ ID NO: 36414 - RNA, 21 nt, Artificial Sequence
  Marburg virus siRNA sense strand
accuguuguccaauugacagc

SEQ ID NO: 36415 - RNA, 21 nt, Artificial Sequence
  Marburg virus siRNA sense strand
ccuguuguccaauugacagcu

SEQ ID NO: 36416 - RNA, 21 nt, Artificial Sequence
  Marburg virus siRNA sense strand
cuguuguccaauugacagcuu

SEQ ID NO: 36417 - RNA, 21 nt, Artificial Sequence
  Marburg virus siRNA sense strand
uguuguccaauugacagcuuu

SEQ ID NO: 36418 - RNA, 21 nt, Artificial Sequence
  Marburg virus siRNA sense strand
guuguccaauugacagcuuuu

SEQ ID NO: 36419 - RNA, 21 nt, Artificial Sequence
  Marburg virus siRNA sense strand
uuguccaauugacagcuuuug

SEQ ID NO: 36420 - RNA, 21 nt, Artificial Sequence
  Marburg virus siRNA sense strand
uguccaauugacagcuuuugg

SEQ ID NO: 36421 - RNA, 21 nt, Artificial Sequence
  Marburg virus siRNA sense strand
guccaauugacagcuuuuggg

SEQ ID NO: 36422 - RNA, 21 nt, Artificial Sequence
  Marburg virus siRNA sense strand
uccaauugacagcuuuugggu

SEQ ID NO: 36423 - RNA, 21 nt, Artificial Sequence
  Marburg virus siRNA sense strand
ccaauugacagcuuuuggguc

SEQ ID NO: 36424 - RNA, 21 nt, Artificial Sequence
  Marburg virus siRNA sense strand
caauugacagcuuuugggucu

SEQ ID NO: 36425 - RNA, 21 nt, Artificial Sequence
  Marburg virus siRNA sense strand
aauugacagcuuuugggucua

SEQ ID NO: 36426 - RNA, 21 nt, Artificial Sequence
  Marburg virus siRNA sense strand
auugacagcuuuugggucuau

SEQ ID NO: 36427 - RNA, 21 nt, Artificial Sequence
  Marburg virus siRNA sense strand
uugacagcuuuugggucuauc

SEQ ID NO: 36428 - RNA, 21 nt, Artificial Sequence
  Marburg virus siRNA sense strand
ugacagcuuuugggucuaucc

SEQ ID NO: 36429 - RNA, 21 nt, Artificial Sequence
  Marburg virus siRNA sense strand
gacagcuuuugggucuaucca

SEQ ID NO: 36430 - RNA, 21 nt, Artificial Sequence
  Marburg virus siRNA sense strand
acagcuuuugggucuauccaa

SEQ ID NO: 36431 - RNA, 21 nt, Artificial Sequence
  Marburg virus siRNA sense strand
cagcuuuugggucuauccaag

SEQ ID NO: 36432 - RNA, 21 nt, Artificial Sequence
  Marburg virus siRNA sense strand
agcuuuugggucuauccaagc

SEQ ID NO: 36433 - RNA, 21 nt, Artificial Sequence
  Marburg virus siRNA sense strand
gcuuuugggucuauccaagca

SEQ ID NO: 36434 - RNA, 21 nt, Artificial Sequence
  Marburg virus siRNA sense strand
cuuuugggucuauccaagcaa

SEQ ID NO: 36435 - RNA, 21 nt, Artificial Sequence
  Marburg virus siRNA sense strand
uuuugggucuauccaagcaag

SEQ ID NO: 36436 - RNA, 21 nt, Artificial Sequence
  Marburg virus siRNA sense strand
uuugggucuauccaagcaagu

SEQ ID NO: 36437 - RNA, 21 nt, Artificial Sequence
  Marburg virus siRNA sense strand
uugggucuauccaagcaaguc

SEQ ID NO: 36438 - RNA, 21 nt, Artificial Sequence
  Marburg virus siRNA sense strand
ugggucuauccaagcaagucc

SEQ ID NO: 36439 - RNA, 21 nt, Artificial Sequence
  Marburg virus siRNA sense strand
gggucuauccaagcaagucca

SEQ ID NO: 36440 - RNA, 21 nt, Artificial Sequence
  Marburg virus siRNA sense strand
ggucuauccaagcaaguccac

SEQ ID NO: 36441 - RNA, 21 nt, Artificial Sequence
  Marburg virus siRNA sense strand
gucuauccaagcaaguccaca

SEQ ID NO: 36442 - RNA, 21 nt, Artificial Sequence
  Marburg virus siRNA sense strand
ucuauccaagcaaguccacaa

SEQ ID NO: 36443 - RNA, 21 nt, Artificial Sequence
  Marburg virus siRNA sense strand
cuauccaagcaaguccacaag

SEQ ID NO: 36444 - RNA, 21 nt, Artificial Sequence
  Marburg virus siRNA sense strand
uauccaagcaaguccacaagg

SEQ ID NO: 36445 - RNA, 21 nt, Artificial Sequence
  Marburg virus siRNA sense strand
auccaagcaaguccacaagga

SEQ ID NO: 36446 - RNA, 21 nt, Artificial Sequence
  Marburg virus siRNA sense strand
uccaagcaaguccacaaggac

SEQ ID NO: 36447 - RNA, 21 nt, Artificial Sequence
  Marburg virus siRNA sense strand
ccaagcaaguccacaaggacu

SEQ ID NO: 36448 - RNA, 21 nt, Artificial Sequence
  Marburg virus siRNA sense strand
caagcaaguccacaaggacua

SEQ ID NO: 36449 - RNA, 21 nt, Artificial Sequence
  Marburg virus siRNA sense strand
aagcaaguccacaaggacuaa

SEQ ID NO: 36450 - RNA, 21 nt, Artificial Sequence
  Marburg virus siRNA sense strand
agcaaguccacaaggacuaac

SEQ ID NO: 36451 - RNA, 21 nt, Artificial Sequence
  Marburg virus siRNA sense strand
gcaaguccacaaggacuaacc

SEQ ID NO: 36452 - RNA, 21 nt, Artificial Sequence
  Marburg virus siRNA sense strand
caaguccacaaggacuaacca

SEQ ID NO: 36453 - RNA, 21 nt, Artificial Sequence
  Marburg virus siRNA sense strand
aaguccacaaggacuaaccac

SEQ ID NO: 36454 - RNA, 21 nt, Artificial Sequence
  Marburg virus siRNA sense strand
aguccacaaggacuaaccacu

SEQ ID NO: 36455 - RNA, 21 nt, Artificial Sequence
  Marburg virus siRNA sense strand
guccacaaggacuaaccacua

SEQ ID NO: 36456 - RNA, 21 nt, Artificial Sequence
  Marburg virus siRNA sense strand
uccacaaggacuaaccacuau

SEQ ID NO: 36457 - RNA, 21 nt, Artificial Sequence
  Marburg virus siRNA sense strand
ccacaaggacuaaccacuauu

SEQ ID NO: 36458 - RNA, 21 nt, Artificial Sequence
  Marburg virus siRNA sense strand
cacaaggacuaaccacuauua

SEQ ID NO: 36459 - RNA, 21 nt, Artificial Sequence
  Marburg virus siRNA sense strand
acaaggacuaaccacuauuau

SEQ ID NO: 36460 - RNA, 21 nt, Artificial Sequence
  Marburg virus siRNA sense strand
caaggacuaaccacuauuaug

SEQ ID NO: 36461 - RNA, 21 nt, Artificial Sequence
  Marburg virus siRNA sense strand
aaggacuaaccacuauuaugc

SEQ ID NO: 36462 - RNA, 21 nt, Artificial Sequence
  Marburg virus siRNA sense strand
aggacuaaccacuauuaugca

SEQ ID NO: 36463 - RNA, 21 nt, Artificial Sequence
  Marburg virus siRNA sense strand
ggacuaaccacuauuaugcaa

SEQ ID NO: 36464 - RNA, 21 nt, Artificial Sequence
  Marburg virus siRNA sense strand
gacuaaccacuauuaugcaag

SEQ ID NO: 36465 - RNA, 21 nt, Artificial Sequence
  Marburg virus siRNA sense strand
acuaaccacuauuaugcaagc

SEQ ID NO: 36466 - RNA, 21 nt, Artificial Sequence
  Marburg virus siRNA sense strand
cuaaccacuauuaugcaagcc

SEQ ID NO: 36467 - RNA, 21 nt, Artificial Sequence
  Marburg virus siRNA sense strand
uaaccacuauuaugcaagccu

SEQ ID NO: 36468 - RNA, 21 nt, Artificial Sequence
  Marburg virus siRNA sense strand
aaccacuauuaugcaagccuu

SEQ ID NO: 36469 - RNA, 21 nt, Artificial Sequence
  Marburg virus siRNA sense strand
accacuauuaugcaagccuua

SEQ ID NO: 36470 - RNA, 21 nt, Artificial Sequence
  Marburg virus siRNA sense strand
ccacuauuaugcaagccuuaa

SEQ ID NO: 36471 - RNA, 21 nt, Artificial Sequence
  Marburg virus siRNA sense strand
cacuauuaugcaagccuuaau

SEQ ID NO: 36472 - RNA, 21 nt, Artificial Sequence
  Marburg virus siRNA sense strand
acuauuaugcaagccuuaauu

SEQ ID NO: 36473 - RNA, 21 nt, Artificial Sequence
  Marburg virus siRNA sense strand
cuauuaugcaagccuuaauua

SEQ ID NO: 36474 - RNA, 21 nt, Artificial Sequence
  Marburg virus siRNA sense strand
uauuaugcaagccuuaauuau

SEQ ID NO: 36475 - RNA, 21 nt, Artificial Sequence
  Marburg virus siRNA sense strand
auuaugcaagccuuaauuauu

SEQ ID NO: 36476 - RNA, 21 nt, Artificial Sequence
  Marburg virus siRNA sense strand
uuaugcaagccuuaauuauug

SEQ ID NO: 36477 - RNA, 21 nt, Artificial Sequence
  Marburg virus siRNA sense strand
uaugcaagccuuaauuauugg

SEQ ID NO: 36478 - RNA, 21 nt, Artificial Sequence
  Marburg virus siRNA sense strand
augcaagccuuaauuauugga

SEQ ID NO: 36479 - RNA, 21 nt, Artificial Sequence
  Marburg virus siRNA sense strand
ugcaagccuuaauuauuggag

SEQ ID NO: 36480 - RNA, 21 nt, Artificial Sequence
  Marburg virus siRNA sense strand
gcaagccuuaauuauuggaga

SEQ ID NO: 36481 - RNA, 21 nt, Artificial Sequence
  Marburg virus siRNA sense strand
caagccuuaauuauuggagag

SEQ ID NO: 36482 - RNA, 21 nt, Artificial Sequence
  Marburg virus siRNA sense strand
aagccuuaauuauuggagaga

SEQ ID NO: 36483 - RNA, 21 nt, Artificial Sequence
  Marburg virus siRNA sense strand
agccuuaauuauuggagagac

SEQ ID NO: 36484 - RNA, 21 nt, Artificial Sequence
  Marburg virus siRNA sense strand
gccuuaauuauuggagagaca

SEQ ID NO: 36485 - RNA, 21 nt, Artificial Sequence
  Marburg virus siRNA sense strand
ccuuaauuauuggagagacaa

SEQ ID NO: 36486 - RNA, 21 nt, Artificial Sequence
  Marburg virus siRNA sense strand
cuuaauuauuggagagacaaa

SEQ ID NO: 36487 - RNA, 21 nt, Artificial Sequence
  Marburg virus siRNA sense strand
uuaauuauuggagagacaaag

SEQ ID NO: 36488 - RNA, 21 nt, Artificial Sequence
  Marburg virus siRNA sense strand
uaauuauuggagagacaaagc

SEQ ID NO: 36489 - RNA, 21 nt, Artificial Sequence
  Marburg virus siRNA sense strand
aauuauuggagagacaaagcu

SEQ ID NO: 36490 - RNA, 21 nt, Artificial Sequence
  Marburg virus siRNA sense strand
auuauuggagagacaaagcua

SEQ ID NO: 36491 - RNA, 21 nt, Artificial Sequence
  Marburg virus siRNA sense strand
uuauuggagagacaaagcuaa

SEQ ID NO: 36492 - RNA, 21 nt, Artificial Sequence
  Marburg virus siRNA sense strand
uauuggagagacaaagcuaau

SEQ ID NO: 36493 - RNA, 21 nt, Artificial Sequence
  Marburg virus siRNA sense strand
auuggagagacaaagcuaaua

SEQ ID NO: 36494 - RNA, 21 nt, Artificial Sequence
  Marburg virus siRNA sense strand
uuggagagacaaagcuaauaa

SEQ ID NO: 36495 - RNA, 21 nt, Artificial Sequence
  Marburg virus siRNA sense strand
uggagagacaaagcuaauaag

SEQ ID NO: 36496 - RNA, 21 nt, Artificial Sequence
  Marburg virus siRNA sense strand
ggagagacaaagcuaauaagg

SEQ ID NO: 36497 - RNA, 21 nt, Artificial Sequence
  Marburg virus siRNA sense strand
gagagacaaagcuaauaaggu

SEQ ID NO: 36498 - RNA, 21 nt, Artificial Sequence
  Marburg virus siRNA sense strand
agagacaaagcuaauaagguc

SEQ ID NO: 36499 - RNA, 21 nt, Artificial Sequence
  Marburg virus siRNA sense strand
gagacaaagcuaauaagguca

SEQ ID NO: 36500 - RNA, 21 nt, Artificial Sequence
  Marburg virus siRNA sense strand
agacaaagcuaauaaggucaa

SEQ ID NO: 36501 - RNA, 21 nt, Artificial Sequence
  Marburg virus siRNA sense strand
gacaaagcuaauaaggucaag

SEQ ID NO: 36502 - RNA, 21 nt, Artificial Sequence
  Marburg virus siRNA sense strand
acaaagcuaauaaggucaaga

SEQ ID NO: 36503 - RNA, 21 nt, Artificial Sequence
  Marburg virus siRNA sense strand
caaagcuaauaaggucaagaa

SEQ ID NO: 36504 - RNA, 21 nt, Artificial Sequence
  Marburg virus siRNA sense strand
aaagcuaauaaggucaagaau

SEQ ID NO: 36505 - RNA, 21 nt, Artificial Sequence
  Marburg virus siRNA sense strand
aagcuaauaaggucaagaaua

SEQ ID NO: 36506 - RNA, 21 nt, Artificial Sequence
  Marburg virus siRNA sense strand
agcuaauaaggucaagaauac

SEQ ID NO: 36507 - RNA, 21 nt, Artificial Sequence
  Marburg virus siRNA sense strand
gcuaauaaggucaagaauacu

SEQ ID NO: 36508 - RNA, 21 nt, Artificial Sequence
  Marburg virus siRNA sense strand
cuaauaaggucaagaauacuc

SEQ ID NO: 36509 - RNA, 21 nt, Artificial Sequence
  Marburg virus siRNA sense strand
uaauaaggucaagaauacucc

SEQ ID NO: 36510 - RNA, 21 nt, Artificial Sequence
  Marburg virus siRNA sense strand
aauaaggucaagaauacuccu

SEQ ID NO: 36511 - RNA, 21 nt, Artificial Sequence
  Marburg virus siRNA sense strand
auaaggucaagaauacuccuu

SEQ ID NO: 36512 - RNA, 21 nt, Artificial Sequence
  Marburg virus siRNA sense strand
uaaggucaagaauacuccuuu

SEQ ID NO: 36513 - RNA, 21 nt, Artificial Sequence
  Marburg virus siRNA sense strand
aaggucaagaauacuccuuuu

SEQ ID NO: 36514 - RNA, 21 nt, Artificial Sequence
  Marburg virus siRNA sense strand
aggucaagaauacuccuuuuu

SEQ ID NO: 36515 - RNA, 21 nt, Artificial Sequence
  Marburg virus siRNA sense strand
ggucaagaauacuccuuuuuc

SEQ ID NO: 36516 - RNA, 21 nt, Artificial Sequence
  Marburg virus siRNA sense strand
gucaagaauacuccuuuuucg

SEQ ID NO: 36517 - RNA, 21 nt, Artificial Sequence
  Marburg virus siRNA sense strand
ucaagaauacuccuuuuucgc

SEQ ID NO: 36518 - RNA, 21 nt, Artificial Sequence
  Marburg virus siRNA sense strand
caagaauacuccuuuuucgca

SEQ ID NO: 36519 - RNA, 21 nt, Artificial Sequence
  Marburg virus siRNA sense strand
aagaauacuccuuuuucgcau

SEQ ID NO: 36520 - RNA, 21 nt, Artificial Sequence
  Marburg virus siRNA sense strand
agaauacuccuuuuucgcauu

SEQ ID NO: 36521 - RNA, 21 nt, Artificial Sequence
  Marburg virus siRNA sense strand
gaauacuccuuuuucgcauuu

SEQ ID NO: 36522 - RNA, 21 nt, Artificial Sequence
  Marburg virus siRNA sense strand
aauacuccuuuuucgcauuug

SEQ ID NO: 36523 - RNA, 21 nt, Artificial Sequence
  Marburg virus siRNA sense strand
auacuccuuuuucgcauuuga

SEQ ID NO: 36524 - RNA, 21 nt, Artificial Sequence
  Marburg virus siRNA sense strand
uacuccuuuuucgcauuugau

SEQ ID NO: 36525 - RNA, 21 nt, Artificial Sequence
  Marburg virus siRNA sense strand
acuccuuuuucgcauuugaua

SEQ ID NO: 36526 - RNA, 21 nt, Artificial Sequence
  Marburg virus siRNA sense strand
cuccuuuuucgcauuugauaa

SEQ ID NO: 36527 - RNA, 21 nt, Artificial Sequence
  Marburg virus siRNA sense strand
uccuuuuucgcauuugauaaa

SEQ ID NO: 36528 - RNA, 21 nt, Artificial Sequence
  Marburg virus siRNA sense strand
ccuuuuucgcauuugauaaau

SEQ ID NO: 36529 - RNA, 21 nt, Artificial Sequence
  Marburg virus siRNA sense strand
cuuuuucgcauuugauaaauu

SEQ ID NO: 36530 - RNA, 21 nt, Artificial Sequence
  Marburg virus siRNA sense strand
uuuuucgcauuugauaaauug

SEQ ID NO: 36531 - RNA, 21 nt, Artificial Sequence
  Marburg virus siRNA sense strand
uuuucgcauuugauaaauugu

SEQ ID NO: 36532 - RNA, 21 nt, Artificial Sequence
  Marburg virus siRNA sense strand
uuucgcauuugauaaauuguu

SEQ ID NO: 36533 - RNA, 21 nt, Artificial Sequence
  Marburg virus siRNA sense strand
uucgcauuugauaaauuguuc

SEQ ID NO: 36534 - RNA, 21 nt, Artificial Sequence
  Marburg virus siRNA sense strand
ucgcauuugauaaauuguuca

SEQ ID NO: 36535 - RNA, 21 nt, Artificial Sequence
  Marburg virus siRNA sense strand
cgcauuugauaaauuguucau

SEQ ID NO: 36536 - RNA, 21 nt, Artificial Sequence
  Marburg virus siRNA sense strand
gcauuugauaaauuguucauu

SEQ ID NO: 36537 - RNA, 21 nt, Artificial Sequence
  Marburg virus siRNA sense strand
cauuugauaaauuguucauuu

SEQ ID NO: 36538 - RNA, 21 nt, Artificial Sequence
  Marburg virus siRNA sense strand
auuugauaaauuguucauuuc

SEQ ID NO: 36539 - RNA, 21 nt, Artificial Sequence
  Marburg virus siRNA sense strand
uuugauaaauuguucauuucu

SEQ ID NO: 36540 - RNA, 21 nt, Artificial Sequence
  Marburg virus siRNA sense strand
uugauaaauuguucauuucuu

SEQ ID NO: 36541 - RNA, 21 nt, Artificial Sequence
  Marburg virus siRNA sense strand
ugauaaauuguucauuucuug

SEQ ID NO: 36542 - RNA, 21 nt, Artificial Sequence
  Marburg virus siRNA sense strand
gauaaauuguucauuucuuga

SEQ ID NO: 36543 - RNA, 21 nt, Artificial Sequence
  Marburg virus siRNA sense strand
auaaauuguucauuucuugaa

SEQ ID NO: 36544 - RNA, 21 nt, Artificial Sequence
  Marburg virus siRNA sense strand
uaaauuguucauuucuugaac

SEQ ID NO: 36545 - RNA, 21 nt, Artificial Sequence
  Marburg virus siRNA sense strand
aaauuguucauuucuugaacu

SEQ ID NO: 36546 - RNA, 21 nt, Artificial Sequence
  Marburg virus siRNA sense strand
aauuguucauuucuugaacuu

SEQ ID NO: 36547 - RNA, 21 nt, Artificial Sequence
  Marburg virus siRNA sense strand
auuguucauuucuugaacuuu

SEQ ID NO: 36548 - RNA, 21 nt, Artificial Sequence
  Marburg virus siRNA sense strand
uuguucauuucuugaacuuuc

SEQ ID NO: 36549 - RNA, 21 nt, Artificial Sequence
  Marburg virus siRNA sense strand
uguucauuucuugaacuuucu

SEQ ID NO: 36550 - RNA, 21 nt, Artificial Sequence
  Marburg virus siRNA sense strand
guucauuucuugaacuuucuu

SEQ ID NO: 36551 - RNA, 21 nt, Artificial Sequence
  Marburg virus siRNA sense strand
uucauuucuugaacuuucuuc

SEQ ID NO: 36552 - RNA, 21 nt, Artificial Sequence
  Marburg virus siRNA sense strand
ucauuucuugaacuuucuuca

SEQ ID NO: 36553 - RNA, 21 nt, Artificial Sequence
  Marburg virus siRNA sense strand
cauuucuugaacuuucuucac

SEQ ID NO: 36554 - RNA, 21 nt, Artificial Sequence
  Marburg virus siRNA sense strand
auuucuugaacuuucuucaca

SEQ ID NO: 36555 - RNA, 21 nt, Artificial Sequence
  Marburg virus siRNA sense strand
uuucuugaacuuucuucacac

SEQ ID NO: 36556 - RNA, 21 nt, Artificial Sequence
  Marburg virus siRNA sense strand
uucuugaacuuucuucacaca

SEQ ID NO: 36557 - RNA, 21 nt, Artificial Sequence
  Marburg virus siRNA sense strand
ucuugaacuuucuucacacac

SEQ ID NO: 36558 - RNA, 21 nt, Artificial Sequence
  Marburg virus siRNA sense strand
cuugaacuuucuucacacacc

SEQ ID NO: 36559 - RNA, 21 nt, Artificial Sequence
  Marburg virus siRNA sense strand
uugaacuuucuucacacacca

SEQ ID NO: 36560 - RNA, 21 nt, Artificial Sequence
  Marburg virus siRNA sense strand
ugaacuuucuucacacaccag

SEQ ID NO: 36561 - RNA, 21 nt, Artificial Sequence
  Marburg virus siRNA sense strand
gaacuuucuucacacaccagu

SEQ ID NO: 36562 - RNA, 21 nt, Artificial Sequence
  Marburg virus siRNA sense strand
aacuuucuucacacaccaguu

SEQ ID NO: 36563 - RNA, 21 nt, Artificial Sequence
  Marburg virus siRNA sense strand
acuuucuucacacaccaguuc

SEQ ID NO: 36564 - RNA, 21 nt, Artificial Sequence
  Marburg virus siRNA sense strand
cuuucuucacacaccaguucg

SEQ ID NO: 36565 - RNA, 21 nt, Artificial Sequence
  Marburg virus siRNA sense strand
uuucuucacacaccaguucgg

SEQ ID NO: 36566 - RNA, 21 nt, Artificial Sequence
  Marburg virus siRNA sense strand
uucuucacacaccaguucggu

SEQ ID NO: 36567 - RNA, 21 nt, Artificial Sequence
  Marburg virus siRNA sense strand
ucuucacacaccaguucgguc

SEQ ID NO: 36568 - RNA, 21 nt, Artificial Sequence
  Marburg virus siRNA sense strand
cuucacacaccaguucggucu

SEQ ID NO: 36569 - RNA, 21 nt, Artificial Sequence
  Marburg virus siRNA sense strand
uucacacaccaguucggucuc

SEQ ID NO: 36570 - RNA, 21 nt, Artificial Sequence
  Marburg virus siRNA sense strand
ucacacaccaguucggucucu

SEQ ID NO: 36571 - RNA, 21 nt, Artificial Sequence
  Marburg virus siRNA sense strand
cacacaccaguucggucucuu

SEQ ID NO: 36572 - RNA, 21 nt, Artificial Sequence
  Marburg virus siRNA sense strand
acacaccaguucggucucuuc

SEQ ID NO: 36573 - RNA, 21 nt, Artificial Sequence
  Marburg virus siRNA sense strand
cacaccaguucggucucuucu

SEQ ID NO: 36574 - RNA, 21 nt, Artificial Sequence
  Marburg virus siRNA sense strand
acaccaguucggucucuucua

SEQ ID NO: 36575 - RNA, 21 nt, Artificial Sequence
  Marburg virus siRNA sense strand
caccaguucggucucuucuaa

SEQ ID NO: 36576 - RNA, 21 nt, Artificial Sequence
  Marburg virus siRNA sense strand
accaguucggucucuucuaau

SEQ ID NO: 36577 - RNA, 21 nt, Artificial Sequence
  Marburg virus siRNA sense strand
ccaguucggucucuucuaauc

SEQ ID NO: 36578 - RNA, 21 nt, Artificial Sequence
  Marburg virus siRNA sense strand
caguucggucucuucuaauca

SEQ ID NO: 36579 - RNA, 21 nt, Artificial Sequence
  Marburg virus siRNA sense strand
aguucggucucuucuaaucaa

SEQ ID NO: 36580 - RNA, 21 nt, Artificial Sequence
  Marburg virus siRNA sense strand
guucggucucuucuaaucaac

SEQ ID NO: 36581 - RNA, 21 nt, Artificial Sequence
  Marburg virus siRNA sense strand
uucggucucuucuaaucaaca

SEQ ID NO: 36582 - RNA, 21 nt, Artificial Sequence
  Marburg virus siRNA sense strand
ucggucucuucuaaucaacaa

SEQ ID NO: 36583 - RNA, 21 nt, Artificial Sequence
  Marburg virus siRNA sense strand
cggucucuucuaaucaacaag

SEQ ID NO: 36584 - RNA, 21 nt, Artificial Sequence
  Marburg virus siRNA sense strand
ggucucuucuaaucaacaagu

SEQ ID NO: 36585 - RNA, 21 nt, Artificial Sequence
  Marburg virus siRNA sense strand
gucucuucuaaucaacaagug

SEQ ID NO: 36586 - RNA, 21 nt, Artificial Sequence
  Marburg virus siRNA sense strand
ucucuucuaaucaacaaguga

SEQ ID NO: 36587 - RNA, 21 nt, Artificial Sequence
  Marburg virus siRNA sense strand
cucuucuaaucaacaagugac

SEQ ID NO: 36588 - RNA, 21 nt, Artificial Sequence
  Marburg virus siRNA sense strand
ucuucuaaucaacaagugacc

SEQ ID NO: 36589 - RNA, 21 nt, Artificial Sequence
  Marburg virus siRNA sense strand
cuucuaaucaacaagugacca

SEQ ID NO: 36590 - RNA, 21 nt, Artificial Sequence
  Marburg virus siRNA sense strand
uucuaaucaacaagugaccaa

SEQ ID NO: 36591 - RNA, 21 nt, Artificial Sequence
  Marburg virus siRNA sense strand
ucuaaucaacaagugaccaau

SEQ ID NO: 36592 - RNA, 21 nt, Artificial Sequence
  Marburg virus siRNA sense strand
cuaaucaacaagugaccaauu

SEQ ID NO: 36593 - RNA, 21 nt, Artificial Sequence
  Marburg virus siRNA sense strand
uaaucaacaagugaccaauuc

SEQ ID NO: 36594 - RNA, 21 nt, Artificial Sequence
  Marburg virus siRNA sense strand
aaucaacaagugaccaauucg

SEQ ID NO: 36595 - RNA, 21 nt, Artificial Sequence
  Marburg virus siRNA sense strand
aucaacaagugaccaauucga

SEQ ID NO: 36596 - RNA, 21 nt, Artificial Sequence
  Marburg virus siRNA sense strand
ucaacaagugaccaauucgaa

SEQ ID NO: 36597 - RNA, 21 nt, Artificial Sequence
  Marburg virus siRNA sense strand
caacaagugaccaauucgaaa

SEQ ID NO: 36598 - RNA, 21 nt, Artificial Sequence
  Marburg virus siRNA sense strand
aacaagugaccaauucgaaau

SEQ ID NO: 36599 - RNA, 21 nt, Artificial Sequence
  Marburg virus siRNA sense strand
acaagugaccaauucgaaaua

SEQ ID NO: 36600 - RNA, 21 nt, Artificial Sequence
  Marburg virus siRNA sense strand
caagugaccaauucgaaauau

SEQ ID NO: 36601 - RNA, 21 nt, Artificial Sequence
  Marburg virus siRNA sense strand
aagugaccaauucgaaauaua

SEQ ID NO: 36602 - RNA, 21 nt, Artificial Sequence
  Marburg virus siRNA sense strand
agugaccaauucgaaauauau

SEQ ID NO: 36603 - RNA, 21 nt, Artificial Sequence
  Marburg virus siRNA sense strand
gugaccaauucgaaauauauu

SEQ ID NO: 36604 - RNA, 21 nt, Artificial Sequence
  Marburg virus siRNA sense strand
ugaccaauucgaaauauauug

SEQ ID NO: 36605 - RNA, 21 nt, Artificial Sequence
  Marburg virus siRNA sense strand
gaccaauucgaaauauauugu

SEQ ID NO: 36606 - RNA, 21 nt, Artificial Sequence
  Marburg virus siRNA sense strand
accaauucgaaauauauuguu

SEQ ID NO: 36607 - RNA, 21 nt, Artificial Sequence
  Marburg virus siRNA sense strand
ccaauucgaaauauauuguuc

SEQ ID NO: 36608 - RNA, 21 nt, Artificial Sequence
  Marburg virus siRNA sense strand
caauucgaaauauauuguuca

SEQ ID NO: 36609 - RNA, 21 nt, Artificial Sequence
  Marburg virus siRNA sense strand
aauucgaaauauauuguucau

SEQ ID NO: 36610 - RNA, 21 nt, Artificial Sequence
  Marburg virus siRNA sense strand
auucgaaauauauuguucauc

SEQ ID NO: 36611 - RNA, 21 nt, Artificial Sequence
  Marburg virus siRNA sense strand
uucgaaauauauuguucaucc

SEQ ID NO: 36612 - RNA, 21 nt, Artificial Sequence
  Marburg virus siRNA sense strand
ucgaaauauauuguucaucca

SEQ ID NO: 36613 - RNA, 21 nt, Artificial Sequence
  Marburg virus siRNA sense strand
cgaaauauauuguucauccag

SEQ ID NO: 36614 - RNA, 21 nt, Artificial Sequence
  Marburg virus siRNA sense strand
gaaauauauuguucauccaga

SEQ ID NO: 36615 - RNA, 21 nt, Artificial Sequence
  Marburg virus siRNA sense strand
aaauauauuguucauccagag

SEQ ID NO: 36616 - RNA, 21 nt, Artificial Sequence
  Marburg virus siRNA sense strand
aauauauuguucauccagaga

SEQ ID NO: 36617 - RNA, 21 nt, Artificial Sequence
  Marburg virus siRNA sense strand
auauauuguucauccagagaa

SEQ ID NO: 36618 - RNA, 21 nt, Artificial Sequence
  Marburg virus siRNA sense strand
uauauuguucauccagagaau

SEQ ID NO: 36619 - RNA, 21 nt, Artificial Sequence
  Marburg virus siRNA sense strand
auauuguucauccagagaaua

SEQ ID NO: 36620 - RNA, 21 nt, Artificial Sequence
  Marburg virus siRNA sense strand
uauuguucauccagagaauau

SEQ ID NO: 36621 - RNA, 21 nt, Artificial Sequence
  Marburg virus siRNA sense strand
auuguucauccagagaauauc

SEQ ID NO: 36622 - RNA, 21 nt, Artificial Sequence
  Marburg virus siRNA sense strand
uuguucauccagagaauaucc

SEQ ID NO: 36623 - RNA, 21 nt, Artificial Sequence
  Marburg virus siRNA sense strand
uguucauccagagaauauccc

SEQ ID NO: 36624 - RNA, 21 nt, Artificial Sequence
  Marburg virus siRNA sense strand
guucauccagagaauaucccu

SEQ ID NO: 36625 - RNA, 21 nt, Artificial Sequence
  Marburg virus siRNA sense strand
uucauccagagaauaucccug

SEQ ID NO: 36626 - RNA, 21 nt, Artificial Sequence
  Marburg virus siRNA sense strand
ucauccagagaauaucccuga

SEQ ID NO: 36627 - RNA, 21 nt, Artificial Sequence
  Marburg virus siRNA sense strand
cauccagagaauaucccugaa

SEQ ID NO: 36628 - RNA, 21 nt, Artificial Sequence
  Marburg virus siRNA sense strand
auccagagaauaucccugaaa

SEQ ID NO: 36629 - RNA, 21 nt, Artificial Sequence
  Marburg virus siRNA sense strand
uccagagaauaucccugaaau

SEQ ID NO: 36630 - RNA, 21 nt, Artificial Sequence
  Marburg virus siRNA sense strand
ccagagaauaucccugaaaua

SEQ ID NO: 36631 - RNA, 21 nt, Artificial Sequence
  Marburg virus siRNA sense strand
cagagaauaucccugaaauaa

SEQ ID NO: 36632 - RNA, 21 nt, Artificial Sequence
  Marburg virus siRNA sense strand
agagaauaucccugaaauaaa

SEQ ID NO: 36633 - RNA, 21 nt, Artificial Sequence
  Marburg virus siRNA sense strand
gagaauaucccugaaauaaau

SEQ ID NO: 36634 - RNA, 21 nt, Artificial Sequence
  Marburg virus siRNA sense strand
agaauaucccugaaauaaaug

SEQ ID NO: 36635 - RNA, 21 nt, Artificial Sequence
  Marburg virus siRNA sense strand
gaauaucccugaaauaaaugc

SEQ ID NO: 36636 - RNA, 21 nt, Artificial Sequence
  Marburg virus siRNA sense strand
aauaucccugaaauaaaugca

SEQ ID NO: 36637 - RNA, 21 nt, Artificial Sequence
  Marburg virus siRNA sense strand
auaucccugaaauaaaugcaa

SEQ ID NO: 36638 - RNA, 21 nt, Artificial Sequence
  Marburg virus siRNA sense strand
uaucccugaaauaaaugcaag

SEQ ID NO: 36639 - RNA, 21 nt, Artificial Sequence
  Marburg virus siRNA sense strand
aucccugaaauaaaugcaaga

SEQ ID NO: 36640 - RNA, 21 nt, Artificial Sequence
  Marburg virus siRNA sense strand
ucccugaaauaaaugcaagaa

SEQ ID NO: 36641 - RNA, 21 nt, Artificial Sequence
  Marburg virus siRNA sense strand
cccugaaauaaaugcaagaac

SEQ ID NO: 36642 - RNA, 21 nt, Artificial Sequence
  Marburg virus siRNA sense strand
ccugaaauaaaugcaagaacc

SEQ ID NO: 36643 - RNA, 21 nt, Artificial Sequence
  Marburg virus siRNA sense strand
cugaaauaaaugcaagaacca

SEQ ID NO: 36644 - RNA, 21 nt, Artificial Sequence
  Marburg virus siRNA sense strand
ugaaauaaaugcaagaaccaa

SEQ ID NO: 36645 - RNA, 21 nt, Artificial Sequence
  Marburg virus siRNA sense strand
gaaauaaaugcaagaaccaaa

SEQ ID NO: 36646 - RNA, 21 nt, Artificial Sequence
  Marburg virus siRNA sense strand
aaauaaaugcaagaaccaaau

SEQ ID NO: 36647 - RNA, 21 nt, Artificial Sequence
  Marburg virus siRNA sense strand
aauaaaugcaagaaccaaauu

SEQ ID NO: 36648 - RNA, 21 nt, Artificial Sequence
  Marburg virus siRNA sense strand
auaaaugcaagaaccaaauua

SEQ ID NO: 36649 - RNA, 21 nt, Artificial Sequence
  Marburg virus siRNA sense strand
uaaaugcaagaaccaaauuaa

SEQ ID NO: 36650 - RNA, 21 nt, Artificial Sequence
  Marburg virus siRNA sense strand
aaaugcaagaaccaaauuaau

SEQ ID NO: 36651 - RNA, 21 nt, Artificial Sequence
  Marburg virus siRNA sense strand
aaugcaagaaccaaauuaaua

SEQ ID NO: 36652 - RNA, 21 nt, Artificial Sequence
  Marburg virus siRNA sense strand
augcaagaaccaaauuaauag

SEQ ID NO: 36653 - RNA, 21 nt, Artificial Sequence
  Marburg virus siRNA sense strand
ugcaagaaccaaauuaauaga

SEQ ID NO: 36654 - RNA, 21 nt, Artificial Sequence
  Marburg virus siRNA sense strand
gcaagaaccaaauuaauagau

SEQ ID NO: 36655 - RNA, 21 nt, Artificial Sequence
  Marburg virus siRNA sense strand
caagaaccaaauuaauagauu

SEQ ID NO: 36656 - RNA, 21 nt, Artificial Sequence
  Marburg virus siRNA sense strand
aagaaccaaauuaauagauua

SEQ ID NO: 36657 - RNA, 21 nt, Artificial Sequence
  Marburg virus siRNA sense strand
agaaccaaauuaauagauuau

SEQ ID NO: 36658 - RNA, 21 nt, Artificial Sequence
  Marburg virus siRNA sense strand
gaaccaaauuaauagauuaug

SEQ ID NO: 36659 - RNA, 21 nt, Artificial Sequence
  Marburg virus siRNA sense strand
aaccaaauuaauagauuaugg

SEQ ID NO: 36660 - RNA, 21 nt, Artificial Sequence
  Marburg virus siRNA sense strand
accaaauuaauagauuaugga

SEQ ID NO: 36661 - RNA, 21 nt, Artificial Sequence
  Marburg virus siRNA sense strand
ccaaauuaauagauuauggau

SEQ ID NO: 36662 - RNA, 21 nt, Artificial Sequence
  Marburg virus siRNA sense strand
caaauuaauagauuauggauc

SEQ ID NO: 36663 - RNA, 21 nt, Artificial Sequence
  Marburg virus siRNA sense strand
aaauuaauagauuauggauca

SEQ ID NO: 36664 - RNA, 21 nt, Artificial Sequence
  Marburg virus siRNA sense strand
aauuaauagauuauggaucaa

SEQ ID NO: 36665 - RNA, 21 nt, Artificial Sequence
  Marburg virus siRNA sense strand
auuaauagauuauggaucaac

SEQ ID NO: 36666 - RNA, 21 nt, Artificial Sequence
  Marburg virus siRNA sense strand
uuaauagauuauggaucaaca

SEQ ID NO: 36667 - RNA, 21 nt, Artificial Sequence
  Marburg virus siRNA sense strand
uaauagauuauggaucaacag

SEQ ID NO: 36668 - RNA, 21 nt, Artificial Sequence
  Marburg virus siRNA sense strand
aauagauuauggaucaacagc

SEQ ID NO: 36669 - RNA, 21 nt, Artificial Sequence
  Marburg virus siRNA sense strand
auagauuauggaucaacagcu

SEQ ID NO: 36670 - RNA, 21 nt, Artificial Sequence
  Marburg virus siRNA sense strand
uagauuauggaucaacagcuc

SEQ ID NO: 36671 - RNA, 21 nt, Artificial Sequence
  Marburg virus siRNA sense strand
agauuauggaucaacagcucu

SEQ ID NO: 36672 - RNA, 21 nt, Artificial Sequence
  Marburg virus siRNA sense strand
gauuauggaucaacagcucua

SEQ ID NO: 36673 - RNA, 21 nt, Artificial Sequence
  Marburg virus siRNA sense strand
auuauggaucaacagcucuac

SEQ ID NO: 36674 - RNA, 21 nt, Artificial Sequence
  Marburg virus siRNA sense strand
uuauggaucaacagcucuaca

SEQ ID NO: 36675 - RNA, 21 nt, Artificial Sequence
  Marburg virus siRNA sense strand
uauggaucaacagcucuacag

SEQ ID NO: 36676 - RNA, 21 nt, Artificial Sequence
  Marburg virus siRNA sense strand
auggaucaacagcucuacagg

SEQ ID NO: 36677 - RNA, 21 nt, Artificial Sequence
  Marburg virus siRNA sense strand
uggaucaacagcucuacaggg

SEQ ID NO: 36678 - RNA, 21 nt, Artificial Sequence
  Marburg virus siRNA sense strand
ggaucaacagcucuacagggg

SEQ ID NO: 36679 - RNA, 21 nt, Artificial Sequence
  Marburg virus siRNA sense strand
gaucaacagcucuacagggga

SEQ ID NO: 36680 - RNA, 21 nt, Artificial Sequence
  Marburg virus siRNA sense strand
aucaacagcucuacaggggau

SEQ ID NO: 36681 - RNA, 21 nt, Artificial Sequence
  Marburg virus siRNA sense strand
ucaacagcucuacaggggaug

SEQ ID NO: 36682 - RNA, 21 nt, Artificial Sequence
  Marburg virus siRNA sense strand
caacagcucuacaggggaugg

SEQ ID NO: 36683 - RNA, 21 nt, Artificial Sequence
  Marburg virus siRNA sense strand
aacagcucuacaggggaugga

SEQ ID NO: 36684 - RNA, 21 nt, Artificial Sequence
  Marburg virus siRNA sense strand
acagcucuacaggggauggau

SEQ ID NO: 36685 - RNA, 21 nt, Artificial Sequence
  Marburg virus siRNA sense strand
cagcucuacaggggauggaua

SEQ ID NO: 36686 - RNA, 21 nt, Artificial Sequence
  Marburg virus siRNA sense strand
agcucuacaggggauggauau

SEQ ID NO: 36687 - RNA, 21 nt, Artificial Sequence
  Marburg virus siRNA sense strand
gcucuacaggggauggauauc

SEQ ID NO: 36688 - RNA, 21 nt, Artificial Sequence
  Marburg virus siRNA sense strand
cucuacaggggauggauauca

SEQ ID NO: 36689 - RNA, 21 nt, Artificial Sequence
  Marburg virus siRNA sense strand
ucuacaggggauggauaucaa

SEQ ID NO: 36690 - RNA, 21 nt, Artificial Sequence
  Marburg virus siRNA sense strand
cuacaggggauggauaucaag

SEQ ID NO: 36691 - RNA, 21 nt, Artificial Sequence
  Marburg virus siRNA sense strand
uacaggggauggauaucaaga

SEQ ID NO: 36692 - RNA, 21 nt, Artificial Sequence
  Marburg virus siRNA sense strand
acaggggauggauaucaagau

SEQ ID NO: 36693 - RNA, 21 nt, Artificial Sequence
  Marburg virus siRNA sense strand
caggggauggauaucaagaug

SEQ ID NO: 36694 - RNA, 21 nt, Artificial Sequence
  Marburg virus siRNA sense strand
aggggauggauaucaagaugc

SEQ ID NO: 36695 - RNA, 21 nt, Artificial Sequence
  Marburg virus siRNA sense strand
ggggauggauaucaagaugcc

SEQ ID NO: 36696 - RNA, 21 nt, Artificial Sequence
  Marburg virus siRNA sense strand
gggauggauaucaagaugcca

SEQ ID NO: 36697 - RNA, 21 nt, Artificial Sequence
  Marburg virus siRNA sense strand
ggauggauaucaagaugccac

SEQ ID NO: 36698 - RNA, 21 nt, Artificial Sequence
  Marburg virus siRNA sense strand
gauggauaucaagaugccacu

SEQ ID NO: 36699 - RNA, 21 nt, Artificial Sequence
  Marburg virus siRNA sense strand
auggauaucaagaugccacuc

SEQ ID NO: 36700 - RNA, 21 nt, Artificial Sequence
  Marburg virus siRNA sense strand
uggauaucaagaugccacucu

SEQ ID NO: 36701 - RNA, 21 nt, Artificial Sequence
  Marburg virus siRNA sense strand
ggauaucaagaugccacucuc

SEQ ID NO: 36702 - RNA, 21 nt, Artificial Sequence
  Marburg virus siRNA sense strand
gauaucaagaugccacucucg

SEQ ID NO: 36703 - RNA, 21 nt, Artificial Sequence
  Marburg virus siRNA sense strand
auaucaagaugccacucucgg

SEQ ID NO: 36704 - RNA, 21 nt, Artificial Sequence
  Marburg virus siRNA sense strand
uaucaagaugccacucucgga

SEQ ID NO: 36705 - RNA, 21 nt, Artificial Sequence
  Marburg virus siRNA sense strand
aucaagaugccacucucggag

SEQ ID NO: 36706 - RNA, 21 nt, Artificial Sequence
  Marburg virus siRNA sense strand
ucaagaugccacucucggagc

SEQ ID NO: 36707 - RNA, 21 nt, Artificial Sequence
  Marburg virus siRNA sense strand
caagaugccacucucggagca

SEQ ID NO: 36708 - RNA, 21 nt, Artificial Sequence
  Marburg virus siRNA sense strand
aagaugccacucucggagcaa

SEQ ID NO: 36709 - RNA, 21 nt, Artificial Sequence
  Marburg virus siRNA sense strand
agaugccacucucggagcaaa

SEQ ID NO: 36710 - RNA, 21 nt, Artificial Sequence
  Marburg virus siRNA sense strand
gaugccacucucggagcaaaa

SEQ ID NO: 36711 - RNA, 21 nt, Artificial Sequence
  Marburg virus siRNA sense strand
augccacucucggagcaaaau

SEQ ID NO: 36712 - RNA, 21 nt, Artificial Sequence
  Marburg virus siRNA sense strand
ugccacucucggagcaaaauc

SEQ ID NO: 36713 - RNA, 21 nt, Artificial Sequence
  Marburg virus siRNA sense strand
gccacucucggagcaaaaucu

SEQ ID NO: 36714 - RNA, 21 nt, Artificial Sequence
  Marburg virus siRNA sense strand
ccacucucggagcaaaaucug

SEQ ID NO: 36715 - RNA, 21 nt, Artificial Sequence
  Marburg virus siRNA sense strand
cacucucggagcaaaaucugg

SEQ ID NO: 36716 - RNA, 21 nt, Artificial Sequence
  Marburg virus siRNA sense strand
acucucggagcaaaaucuggu

SEQ ID NO: 36717 - RNA, 21 nt, Artificial Sequence
  Marburg virus siRNA sense strand
cucucggagcaaaaucugguu

SEQ ID NO: 36718 - RNA, 21 nt, Artificial Sequence
  Marburg virus siRNA sense strand
ucucggagcaaaaucugguug

SEQ ID NO: 36719 - RNA, 21 nt, Artificial Sequence
  Marburg virus siRNA sense strand
cucggagcaaaaucugguugg

SEQ ID NO: 36720 - RNA, 21 nt, Artificial Sequence
  Marburg virus siRNA sense strand
ucggagcaaaaucugguugga

SEQ ID NO: 36721 - RNA, 21 nt, Artificial Sequence
  Marburg virus siRNA sense strand
cggagcaaaaucugguuggaa

SEQ ID NO: 36722 - RNA, 21 nt, Artificial Sequence
  Marburg virus siRNA sense strand
ggagcaaaaucugguuggaaa

SEQ ID NO: 36723 - RNA, 21 nt, Artificial Sequence
  Marburg virus siRNA sense strand
gagcaaaaucugguuggaaau

SEQ ID NO: 36724 - RNA, 21 nt, Artificial Sequence
  Marburg virus siRNA sense strand
agcaaaaucugguuggaaauu

SEQ ID NO: 36725 - RNA, 21 nt, Artificial Sequence
  Marburg virus siRNA sense strand
gcaaaaucugguuggaaauug

SEQ ID NO: 36726 - RNA, 21 nt, Artificial Sequence
  Marburg virus siRNA sense strand
caaaaucugguuggaaauugu

SEQ ID NO: 36727 - RNA, 21 nt, Artificial Sequence
  Marburg virus siRNA sense strand
aaaaucugguuggaaauuguc

SEQ ID NO: 36728 - RNA, 21 nt, Artificial Sequence
  Marburg virus siRNA sense strand
aaaucugguuggaaauugucg

SEQ ID NO: 36729 - RNA, 21 nt, Artificial Sequence
  Marburg virus siRNA sense strand
aaucugguuggaaauugucga

SEQ ID NO: 36730 - RNA, 21 nt, Artificial Sequence
  Marburg virus siRNA sense strand
aucugguuggaaauugucgac

SEQ ID NO: 36731 - RNA, 21 nt, Artificial Sequence
  Marburg virus siRNA sense strand
ucugguuggaaauugucgacc

SEQ ID NO: 36732 - RNA, 21 nt, Artificial Sequence
  Marburg virus siRNA sense strand
cugguuggaaauugucgacca

SEQ ID NO: 36733 - RNA, 21 nt, Artificial Sequence
  Marburg virus siRNA sense strand
ugguuggaaauugucgaccau

SEQ ID NO: 36734 - RNA, 21 nt, Artificial Sequence
  Marburg virus siRNA sense strand
gguuggaaauugucgaccauc

SEQ ID NO: 36735 - RNA, 21 nt, Artificial Sequence
  Marburg virus siRNA sense strand
guuggaaauugucgaccauca

SEQ ID NO: 36736 - RNA, 21 nt, Artificial Sequence
  Marburg virus siRNA sense strand
uuggaaauugucgaccaucaa

SEQ ID NO: 36737 - RNA, 21 nt, Artificial Sequence
  Marburg virus siRNA sense strand
uggaaauugucgaccaucaaa

SEQ ID NO: 36738 - RNA, 21 nt, Artificial Sequence
  Marburg virus siRNA sense strand
ggaaauugucgaccaucaaag

SEQ ID NO: 36739 - RNA, 21 nt, Artificial Sequence
  Marburg virus siRNA sense strand
gaaauugucgaccaucaaagg

SEQ ID NO: 36740 - RNA, 21 nt, Artificial Sequence
  Marburg virus siRNA sense strand
aaauugucgaccaucaaaggg

SEQ ID NO: 36741 - RNA, 21 nt, Artificial Sequence
  Marburg virus siRNA sense strand
aauugucgaccaucaaagggc

SEQ ID NO: 36742 - RNA, 21 nt, Artificial Sequence
  Marburg virus siRNA sense strand
auugucgaccaucaaagggca

SEQ ID NO: 36743 - RNA, 21 nt, Artificial Sequence
  Marburg virus siRNA sense strand
uugucgaccaucaaagggcau

SEQ ID NO: 36744 - RNA, 21 nt, Artificial Sequence
  Marburg virus siRNA sense strand
ugucgaccaucaaagggcauu

SEQ ID NO: 36745 - RNA, 21 nt, Artificial Sequence
  Marburg virus siRNA sense strand
gucgaccaucaaagggcauua

SEQ ID NO: 36746 - RNA, 21 nt, Artificial Sequence
  Marburg virus siRNA sense strand
ucgaccaucaaagggcauuag

SEQ ID NO: 36747 - RNA, 21 nt, Artificial Sequence
  Marburg virus siRNA sense strand
cgaccaucaaagggcauuaga

SEQ ID NO: 36748 - RNA, 21 nt, Artificial Sequence
  Marburg virus siRNA sense strand
gaccaucaaagggcauuagau

SEQ ID NO: 36749 - RNA, 21 nt, Artificial Sequence
  Marburg virus siRNA sense strand
accaucaaagggcauuagauu

SEQ ID NO: 36750 - RNA, 21 nt, Artificial Sequence
  Marburg virus siRNA sense strand
ccaucaaagggcauuagauuc

SEQ ID NO: 36751 - RNA, 21 nt, Artificial Sequence
  Marburg virus siRNA sense strand
caucaaagggcauuagauuca

SEQ ID NO: 36752 - RNA, 21 nt, Artificial Sequence
  Marburg virus siRNA sense strand
aucaaagggcauuagauucaa

SEQ ID NO: 36753 - RNA, 21 nt, Artificial Sequence
  Marburg virus siRNA sense strand
ucaaagggcauuagauucaag

SEQ ID NO: 36754 - RNA, 21 nt, Artificial Sequence
  Marburg virus siRNA sense strand
caaagggcauuagauucaagg

SEQ ID NO: 36755 - RNA, 21 nt, Artificial Sequence
  Marburg virus siRNA sense strand
aaagggcauuagauucaagga

SEQ ID NO: 36756 - RNA, 21 nt, Artificial Sequence
  Marburg virus siRNA sense strand
aagggcauuagauucaaggac

SEQ ID NO: 36757 - RNA, 21 nt, Artificial Sequence
  Marburg virus siRNA sense strand
agggcauuagauucaaggaca

SEQ ID NO: 36758 - RNA, 21 nt, Artificial Sequence
  Marburg virus siRNA sense strand
gggcauuagauucaaggacaa

SEQ ID NO: 36759 - RNA, 21 nt, Artificial Sequence
  Marburg virus siRNA sense strand
ggcauuagauucaaggacaau

SEQ ID NO: 36760 - RNA, 21 nt, Artificial Sequence
  Marburg virus siRNA sense strand
gcauuagauucaaggacaauc

SEQ ID NO: 36761 - RNA, 21 nt, Artificial Sequence
  Marburg virus siRNA sense strand
cauuagauucaaggacaaucc

SEQ ID NO: 36762 - RNA, 21 nt, Artificial Sequence
  Marburg virus siRNA sense strand
auuagauucaaggacaaucca

SEQ ID NO: 36763 - RNA, 21 nt, Artificial Sequence
  Marburg virus siRNA sense strand
uuagauucaaggacaauccaa

SEQ ID NO: 36764 - RNA, 21 nt, Artificial Sequence
  Marburg virus siRNA sense strand
uagauucaaggacaauccaaa

SEQ ID NO: 36765 - RNA, 21 nt, Artificial Sequence
  Marburg virus siRNA sense strand
agauucaaggacaauccaaaa

SEQ ID NO: 36766 - RNA, 21 nt, Artificial Sequence
  Marburg virus siRNA sense strand
gauucaaggacaauccaaaaa

SEQ ID NO: 36767 - RNA, 21 nt, Artificial Sequence
  Marburg virus siRNA sense strand
auucaaggacaauccaaaaac

SEQ ID NO: 36768 - RNA, 21 nt, Artificial Sequence
  Marburg virus siRNA sense strand
uucaaggacaauccaaaaaca

SEQ ID NO: 36769 - RNA, 21 nt, Artificial Sequence
  Marburg virus siRNA sense strand
ucaaggacaauccaaaaacaa

SEQ ID NO: 36770 - RNA, 21 nt, Artificial Sequence
  Marburg virus siRNA sense strand
caaggacaauccaaaaacaac

SEQ ID NO: 36771 - RNA, 21 nt, Artificial Sequence
  Marburg virus siRNA sense strand
aaggacaauccaaaaacaaca

SEQ ID NO: 36772 - RNA, 21 nt, Artificial Sequence
  Marburg virus siRNA sense strand
aggacaauccaaaaacaacaa

SEQ ID NO: 36773 - RNA, 21 nt, Artificial Sequence
  Marburg virus siRNA sense strand
ggacaauccaaaaacaacaaa

SEQ ID NO: 36774 - RNA, 21 nt, Artificial Sequence
  Marburg virus siRNA sense strand
gacaauccaaaaacaacaaaa

SEQ ID NO: 36775 - RNA, 21 nt, Artificial Sequence
  Marburg virus siRNA sense strand
acaauccaaaaacaacaaaac

SEQ ID NO: 36776 - RNA, 21 nt, Artificial Sequence
  Marburg virus siRNA sense strand
caauccaaaaacaacaaaaca

SEQ ID NO: 36777 - RNA, 21 nt, Artificial Sequence
  Marburg virus siRNA sense strand
aauccaaaaacaacaaaacau

SEQ ID NO: 36778 - RNA, 21 nt, Artificial Sequence
  Marburg virus siRNA sense strand
auccaaaaacaacaaaacaug

SEQ ID NO: 36779 - RNA, 21 nt, Artificial Sequence
  Marburg virus siRNA sense strand
uccaaaaacaacaaaacauga

SEQ ID NO: 36780 - RNA, 21 nt, Artificial Sequence
  Marburg virus siRNA sense strand
ccaaaaacaacaaaacaugac

SEQ ID NO: 36781 - RNA, 21 nt, Artificial Sequence
  Marburg virus siRNA sense strand
caaaaacaacaaaacaugacc

SEQ ID NO: 36782 - RNA, 21 nt, Artificial Sequence
  Marburg virus siRNA sense strand
aaaaacaacaaaacaugacca

SEQ ID NO: 36783 - RNA, 21 nt, Artificial Sequence
  Marburg virus siRNA sense strand
aaaacaacaaaacaugaccag

SEQ ID NO: 36784 - RNA, 21 nt, Artificial Sequence
  Marburg virus siRNA sense strand
aaacaacaaaacaugaccagg

SEQ ID NO: 36785 - RNA, 21 nt, Artificial Sequence
  Marburg virus siRNA sense strand
aacaacaaaacaugaccaggg

SEQ ID NO: 36786 - RNA, 21 nt, Artificial Sequence
  Marburg virus siRNA sense strand
acaacaaaacaugaccaggga

SEQ ID NO: 36787 - RNA, 21 nt, Artificial Sequence
  Marburg virus siRNA sense strand
caacaaaacaugaccagggau

SEQ ID NO: 36788 - RNA, 21 nt, Artificial Sequence
  Marburg virus siRNA sense strand
aacaaaacaugaccagggauu

SEQ ID NO: 36789 - RNA, 21 nt, Artificial Sequence
  Marburg virus siRNA sense strand
acaaaacaugaccagggauuu

SEQ ID NO: 36790 - RNA, 21 nt, Artificial Sequence
  Marburg virus siRNA sense strand
caaaacaugaccagggauuug

SEQ ID NO: 36791 - RNA, 21 nt, Artificial Sequence
  Marburg virus siRNA sense strand
aaaacaugaccagggauuugu

SEQ ID NO: 36792 - RNA, 21 nt, Artificial Sequence
  Marburg virus siRNA sense strand
aaacaugaccagggauuugug

SEQ ID NO: 36793 - RNA, 21 nt, Artificial Sequence
  Marburg virus siRNA sense strand
aacaugaccagggauuugugg

SEQ ID NO: 36794 - RNA, 21 nt, Artificial Sequence
  Marburg virus siRNA sense strand
acaugaccagggauuuguggg

SEQ ID NO: 36795 - RNA, 21 nt, Artificial Sequence
  Marburg virus siRNA sense strand
caugaccagggauuugugggg

SEQ ID NO: 36796 - RNA, 21 nt, Artificial Sequence
  Marburg virus siRNA sense strand
augaccagggauuugugggga

SEQ ID NO: 36797 - RNA, 21 nt, Artificial Sequence
  Marburg virus siRNA sense strand
ugaccagggauuuguggggaa

SEQ ID NO: 36798 - RNA, 21 nt, Artificial Sequence
  Marburg virus siRNA sense strand
gaccagggauuuguggggaag

SEQ ID NO: 36799 - RNA, 21 nt, Artificial Sequence
  Marburg virus siRNA sense strand
accagggauuuguggggaagg

SEQ ID NO: 36800 - RNA, 21 nt, Artificial Sequence
  Marburg virus siRNA sense strand
ccagggauuuguggggaagga

SEQ ID NO: 36801 - RNA, 21 nt, Artificial Sequence
  Marburg virus siRNA sense strand
cagggauuuguggggaaggac

SEQ ID NO: 36802 - RNA, 21 nt, Artificial Sequence
  Marburg virus siRNA sense strand
agggauuuguggggaaggacu

SEQ ID NO: 36803 - RNA, 21 nt, Artificial Sequence
  Marburg virus siRNA sense strand
gggauuuguggggaaggacuc

SEQ ID NO: 36804 - RNA, 21 nt, Artificial Sequence
  Marburg virus siRNA sense strand
ggauuuguggggaaggacucu

SEQ ID NO: 36805 - RNA, 21 nt, Artificial Sequence
  Marburg virus siRNA sense strand
gauuuguggggaaggacucuu

SEQ ID NO: 36806 - RNA, 21 nt, Artificial Sequence
  Marburg virus siRNA sense strand
auuuguggggaaggacucuuc

SEQ ID NO: 36807 - RNA, 21 nt, Artificial Sequence
  Marburg virus siRNA sense strand
uuuguggggaaggacucuuca

SEQ ID NO: 36808 - RNA, 21 nt, Artificial Sequence
  Marburg virus siRNA sense strand
uuguggggaaggacucuucac

SEQ ID NO: 36809 - RNA, 21 nt, Artificial Sequence
  Marburg virus siRNA sense strand
uguggggaaggacucuucacc

SEQ ID NO: 36810 - RNA, 21 nt, Artificial Sequence
  Marburg virus siRNA sense strand
guggggaaggacucuucaccg

SEQ ID NO: 36811 - RNA, 21 nt, Artificial Sequence
  Marburg virus siRNA sense strand
uggggaaggacucuucaccgc

SEQ ID NO: 36812 - RNA, 21 nt, Artificial Sequence
  Marburg virus siRNA sense strand
ggggaaggacucuucaccgcg

SEQ ID NO: 36813 - RNA, 21 nt, Artificial Sequence
  Marburg virus siRNA sense strand
gggaaggacucuucaccgcga

SEQ ID NO: 36814 - RNA, 21 nt, Artificial Sequence
  Marburg virus siRNA sense strand
ggaaggacucuucaccgcgac

SEQ ID NO: 36815 - RNA, 21 nt, Artificial Sequence
  Marburg virus siRNA sense strand
gaaggacucuucaccgcgacc

SEQ ID NO: 36816 - RNA, 21 nt, Artificial Sequence
  Marburg virus siRNA sense strand
aaggacucuucaccgcgacca

SEQ ID NO: 36817 - RNA, 21 nt, Artificial Sequence
  Marburg virus siRNA sense strand
aggacucuucaccgcgaccaa

SEQ ID NO: 36818 - RNA, 21 nt, Artificial Sequence
  Marburg virus siRNA sense strand
ggacucuucaccgcgaccaau

SEQ ID NO: 36819 - RNA, 21 nt, Artificial Sequence
  Marburg virus siRNA sense strand
gacucuucaccgcgaccaaug

SEQ ID NO: 36820 - RNA, 21 nt, Artificial Sequence
  Marburg virus siRNA sense strand
acucuucaccgcgaccaaugu

SEQ ID NO: 36821 - RNA, 21 nt, Artificial Sequence
  Marburg virus siRNA sense strand
cucuucaccgcgaccaauguc

SEQ ID NO: 36822 - RNA, 21 nt, Artificial Sequence
  Marburg virus siRNA sense strand
ucuucaccgcgaccaaugucc

SEQ ID NO: 36823 - RNA, 21 nt, Artificial Sequence
  Marburg virus siRNA sense strand
cuucaccgcgaccaauguccc

SEQ ID NO: 36824 - RNA, 21 nt, Artificial Sequence
  Marburg virus siRNA sense strand
uucaccgcgaccaaugucccc

SEQ ID NO: 36825 - RNA, 21 nt, Artificial Sequence
  Marburg virus siRNA sense strand
ucaccgcgaccaauguccccu

SEQ ID NO: 36826 - RNA, 21 nt, Artificial Sequence
  Marburg virus siRNA sense strand
caccgcgaccaauguccccug

SEQ ID NO: 36827 - RNA, 21 nt, Artificial Sequence
  Marburg virus siRNA sense strand
accgcgaccaauguccccuga

SEQ ID NO: 36828 - RNA, 21 nt, Artificial Sequence
  Marburg virus siRNA sense strand
ccgcgaccaauguccccugaa

SEQ ID NO: 36829 - RNA, 21 nt, Artificial Sequence
  Marburg virus siRNA sense strand
cgcgaccaauguccccugaag

SEQ ID NO: 36830 - RNA, 21 nt, Artificial Sequence
  Marburg virus siRNA sense strand
gcgaccaauguccccugaaga

SEQ ID NO: 36831 - RNA, 21 nt, Artificial Sequence
  Marburg virus siRNA sense strand
cgaccaauguccccugaagac

SEQ ID NO: 36832 - RNA, 21 nt, Artificial Sequence
  Marburg virus siRNA sense strand
gaccaauguccccugaagaca

SEQ ID NO: 36833 - RNA, 21 nt, Artificial Sequence
  Marburg virus siRNA sense strand
accaauguccccugaagacaa

SEQ ID NO: 36834 - RNA, 21 nt, Artificial Sequence
  Marburg virus siRNA sense strand
ccaauguccccugaagacaac

SEQ ID NO: 36835 - RNA, 21 nt, Artificial Sequence
  Marburg virus siRNA sense strand
caauguccccugaagacaaca

SEQ ID NO: 36836 - RNA, 21 nt, Artificial Sequence
  Marburg virus siRNA sense strand
aauguccccugaagacaacau

SEQ ID NO: 36837 - RNA, 21 nt, Artificial Sequence
  Marburg virus siRNA sense strand
auguccccugaagacaacaug

SEQ ID NO: 36838 - RNA, 21 nt, Artificial Sequence
  Marburg virus siRNA sense strand
uguccccugaagacaacaugc

SEQ ID NO: 36839 - RNA, 21 nt, Artificial Sequence
  Marburg virus siRNA sense strand
guccccugaagacaacaugca

SEQ ID NO: 36840 - RNA, 21 nt, Artificial Sequence
  Marburg virus siRNA sense strand
uccccugaagacaacaugcag

SEQ ID NO: 36841 - RNA, 21 nt, Artificial Sequence
  Marburg virus siRNA sense strand
ccccugaagacaacaugcaga

SEQ ID NO: 36842 - RNA, 21 nt, Artificial Sequence
  Marburg virus siRNA sense strand
cccugaagacaacaugcagac

SEQ ID NO: 36843 - RNA, 21 nt, Artificial Sequence
  Marburg virus siRNA sense strand
ccugaagacaacaugcagacu

SEQ ID NO: 36844 - RNA, 21 nt, Artificial Sequence
  Marburg virus siRNA sense strand
cugaagacaacaugcagacuc

SEQ ID NO: 36845 - RNA, 21 nt, Artificial Sequence
  Marburg virus siRNA sense strand
ugaagacaacaugcagacucc

SEQ ID NO: 36846 - RNA, 21 nt, Artificial Sequence
  Marburg virus siRNA sense strand
gaagacaacaugcagacuccu

SEQ ID NO: 36847 - RNA, 21 nt, Artificial Sequence
  Marburg virus siRNA sense strand
aagacaacaugcagacuccug

SEQ ID NO: 36848 - RNA, 21 nt, Artificial Sequence
  Marburg virus siRNA sense strand
agacaacaugcagacuccugc

SEQ ID NO: 36849 - RNA, 21 nt, Artificial Sequence
  Marburg virus siRNA sense strand
gacaacaugcagacuccugca

SEQ ID NO: 36850 - RNA, 21 nt, Artificial Sequence
  Marburg virus siRNA sense strand
acaacaugcagacuccugcau

SEQ ID NO: 36851 - RNA, 21 nt, Artificial Sequence
  Marburg virus siRNA sense strand
caacaugcagacuccugcaua

SEQ ID NO: 36852 - RNA, 21 nt, Artificial Sequence
  Marburg virus siRNA sense strand
aacaugcagacuccugcauac

SEQ ID NO: 36853 - RNA, 21 nt, Artificial Sequence
  Marburg virus siRNA sense strand
acaugcagacuccugcauaca

SEQ ID NO: 36854 - RNA, 21 nt, Artificial Sequence
  Marburg virus siRNA sense strand
caugcagacuccugcauacau

SEQ ID NO: 36855 - RNA, 21 nt, Artificial Sequence
  Marburg virus siRNA sense strand
augcagacuccugcauacaua

SEQ ID NO: 36856 - RNA, 21 nt, Artificial Sequence
  Marburg virus siRNA sense strand
ugcagacuccugcauacauac

SEQ ID NO: 36857 - RNA, 21 nt, Artificial Sequence
  Marburg virus siRNA sense strand
gcagacuccugcauacauaca

SEQ ID NO: 36858 - RNA, 21 nt, Artificial Sequence
  Marburg virus siRNA sense strand
cagacuccugcauacauacau

SEQ ID NO: 36859 - RNA, 21 nt, Artificial Sequence
  Marburg virus siRNA sense strand
agacuccugcauacauacaua

SEQ ID NO: 36860 - RNA, 21 nt, Artificial Sequence
  Marburg virus siRNA sense strand
gacuccugcauacauacauag

SEQ ID NO: 36861 - RNA, 21 nt, Artificial Sequence
  Marburg virus siRNA sense strand
acuccugcauacauacauagu

SEQ ID NO: 36862 - RNA, 21 nt, Artificial Sequence
  Marburg virus siRNA sense strand
cuccugcauacauacauaguu

SEQ ID NO: 36863 - RNA, 21 nt, Artificial Sequence
  Marburg virus siRNA sense strand
uccugcauacauacauaguuc

SEQ ID NO: 36864 - RNA, 21 nt, Artificial Sequence
  Marburg virus siRNA sense strand
ccugcauacauacauaguucc

SEQ ID NO: 36865 - RNA, 21 nt, Artificial Sequence
  Marburg virus siRNA sense strand
cugcauacauacauaguuccc

SEQ ID NO: 36866 - RNA, 21 nt, Artificial Sequence
  Marburg virus siRNA sense strand
ugcauacauacauaguucccc

SEQ ID NO: 36867 - RNA, 21 nt, Artificial Sequence
  Marburg virus siRNA sense strand
gcauacauacauaguuccccc

SEQ ID NO: 36868 - RNA, 21 nt, Artificial Sequence
  Marburg virus siRNA sense strand
cauacauacauaguucccccc

SEQ ID NO: 36869 - RNA, 21 nt, Artificial Sequence
  Marburg virus siRNA sense strand
auacauacauaguuccccccc

SEQ ID NO: 36870 - RNA, 21 nt, Artificial Sequence
  Marburg virus siRNA sense strand
uacauacauaguuccccccca

SEQ ID NO: 36871 - RNA, 21 nt, Artificial Sequence
  Marburg virus siRNA sense strand
acauacauaguucccccccau

SEQ ID NO: 36872 - RNA, 21 nt, Artificial Sequence
  Marburg virus siRNA sense strand
cauacauaguucccccccaua

SEQ ID NO: 36873 - RNA, 21 nt, Artificial Sequence
  Marburg virus siRNA sense strand
auacauaguucccccccauau

SEQ ID NO: 36874 - RNA, 21 nt, Artificial Sequence
  Marburg virus siRNA sense strand
uacauaguucccccccauauc

SEQ ID NO: 36875 - RNA, 21 nt, Artificial Sequence
  Marburg virus siRNA sense strand
acauaguucccccccauauca

SEQ ID NO: 36876 - RNA, 21 nt, Artificial Sequence
  Marburg virus siRNA sense strand
cauaguucccccccauaucaa

SEQ ID NO: 36877 - RNA, 21 nt, Artificial Sequence
  Marburg virus siRNA sense strand
auaguucccccccauaucaaa

SEQ ID NO: 36878 - RNA, 21 nt, Artificial Sequence
  Marburg virus siRNA sense strand
uaguucccccccauaucaaac

SEQ ID NO: 36879 - RNA, 21 nt, Artificial Sequence
  Marburg virus siRNA sense strand
aguucccccccauaucaaacc

SEQ ID NO: 36880 - RNA, 21 nt, Artificial Sequence
  Marburg virus siRNA sense strand
guucccccccauaucaaaccc

SEQ ID NO: 36881 - RNA, 21 nt, Artificial Sequence
  Marburg virus siRNA sense strand
uucccccccauaucaaacccu

SEQ ID NO: 36882 - RNA, 21 nt, Artificial Sequence
  Marburg virus siRNA sense strand
ucccccccauaucaaacccuu

SEQ ID NO: 36883 - RNA, 21 nt, Artificial Sequence
  Marburg virus siRNA sense strand
cccccccauaucaaacccuua

SEQ ID NO: 36884 - RNA, 21 nt, Artificial Sequence
  Marburg virus siRNA sense strand
ccccccauaucaaacccuuac

SEQ ID NO: 36885 - RNA, 21 nt, Artificial Sequence
  Marburg virus siRNA sense strand
cccccauaucaaacccuuaca

SEQ ID NO: 36886 - RNA, 21 nt, Artificial Sequence
  Marburg virus siRNA sense strand
ccccauaucaaacccuuacaa

SEQ ID NO: 36887 - RNA, 21 nt, Artificial Sequence
  Marburg virus siRNA sense strand
cccauaucaaacccuuacaaa

SEQ ID NO: 36888 - RNA, 21 nt, Artificial Sequence
  Marburg virus siRNA sense strand
ccauaucaaacccuuacaaaa

SEQ ID NO: 36889 - RNA, 21 nt, Artificial Sequence
  Marburg virus siRNA sense strand
cauaucaaacccuuacaaaau

SEQ ID NO: 36890 - RNA, 21 nt, Artificial Sequence
  Marburg virus siRNA sense strand
auaucaaacccuuacaaaauc

SEQ ID NO: 36891 - RNA, 21 nt, Artificial Sequence
  Marburg virus siRNA sense strand
uaucaaacccuuacaaaauca

SEQ ID NO: 36892 - RNA, 21 nt, Artificial Sequence
  Marburg virus siRNA sense strand
aucaaacccuuacaaaaucac

SEQ ID NO: 36893 - RNA, 21 nt, Artificial Sequence
  Marburg virus siRNA sense strand
ucaaacccuuacaaaaucacc

SEQ ID NO: 36894 - RNA, 21 nt, Artificial Sequence
  Marburg virus siRNA sense strand
caaacccuuacaaaaucacca

SEQ ID NO: 36895 - RNA, 21 nt, Artificial Sequence
  Marburg virus siRNA sense strand
aaacccuuacaaaaucaccag

SEQ ID NO: 36896 - RNA, 21 nt, Artificial Sequence
  Marburg virus siRNA sense strand
aacccuuacaaaaucaccaga

SEQ ID NO: 36897 - RNA, 21 nt, Artificial Sequence
  Marburg virus siRNA sense strand
acccuuacaaaaucaccagau

SEQ ID NO: 36898 - RNA, 21 nt, Artificial Sequence
  Marburg virus siRNA sense strand
cccuuacaaaaucaccagaug

SEQ ID NO: 36899 - RNA, 21 nt, Artificial Sequence
  Marburg virus siRNA sense strand
ccuuacaaaaucaccagaugu

SEQ ID NO: 36900 - RNA, 21 nt, Artificial Sequence
  Marburg virus siRNA sense strand
cuuacaaaaucaccagaugua

SEQ ID NO: 36901 - RNA, 21 nt, Artificial Sequence
  Marburg virus siRNA sense strand
uuacaaaaucaccagauguac

SEQ ID NO: 36902 - RNA, 21 nt, Artificial Sequence
  Marburg virus siRNA sense strand
uacaaaaucaccagauguaca

SEQ ID NO: 36903 - RNA, 21 nt, Artificial Sequence
  Marburg virus siRNA sense strand
acaaaaucaccagauguacau

SEQ ID NO: 36904 - RNA, 21 nt, Artificial Sequence
  Marburg virus siRNA sense strand
caaaaucaccagauguacaug

SEQ ID NO: 36905 - RNA, 21 nt, Artificial Sequence
  Marburg virus siRNA sense strand
aaaaucaccagauguacauga

SEQ ID NO: 36906 - RNA, 21 nt, Artificial Sequence
  Marburg virus siRNA sense strand
aaaucaccagauguacaugag

SEQ ID NO: 36907 - RNA, 21 nt, Artificial Sequence
  Marburg virus siRNA sense strand
aaucaccagauguacaugagg

SEQ ID NO: 36908 - RNA, 21 nt, Artificial Sequence
  Marburg virus siRNA sense strand
aucaccagauguacaugagga

SEQ ID NO: 36909 - RNA, 21 nt, Artificial Sequence
  Marburg virus siRNA sense strand
ucaccagauguacaugaggac

SEQ ID NO: 36910 - RNA, 21 nt, Artificial Sequence
  Marburg virus siRNA sense strand
caccagauguacaugaggacu

SEQ ID NO: 36911 - RNA, 21 nt, Artificial Sequence
  Marburg virus siRNA sense strand
accagauguacaugaggacuu

SEQ ID NO: 36912 - RNA, 21 nt, Artificial Sequence
  Marburg virus siRNA sense strand
ccagauguacaugaggacuuu

SEQ ID NO: 36913 - RNA, 21 nt, Artificial Sequence
  Marburg virus siRNA sense strand
cagauguacaugaggacuuug

SEQ ID NO: 36914 - RNA, 21 nt, Artificial Sequence
  Marburg virus siRNA sense strand
agauguacaugaggacuuuga

SEQ ID NO: 36915 - RNA, 21 nt, Artificial Sequence
  Marburg virus siRNA sense strand
gauguacaugaggacuuugau

SEQ ID NO: 36916 - RNA, 21 nt, Artificial Sequence
  Marburg virus siRNA sense strand
auguacaugaggacuuugaug

SEQ ID NO: 36917 - RNA, 21 nt, Artificial Sequence
  Marburg virus siRNA sense strand
uguacaugaggacuuugaugc

SEQ ID NO: 36918 - RNA, 21 nt, Artificial Sequence
  Marburg virus siRNA sense strand
guacaugaggacuuugaugcc

SEQ ID NO: 36919 - RNA, 21 nt, Artificial Sequence
  Marburg virus siRNA sense strand
uacaugaggacuuugaugccu

SEQ ID NO: 36920 - RNA, 21 nt, Artificial Sequence
  Marburg virus siRNA sense strand
acaugaggacuuugaugccuc

SEQ ID NO: 36921 - RNA, 21 nt, Artificial Sequence
  Marburg virus siRNA sense strand
caugaggacuuugaugccucg

SEQ ID NO: 36922 - RNA, 21 nt, Artificial Sequence
  Marburg virus siRNA sense strand
augaggacuuugaugccucga

SEQ ID NO: 36923 - RNA, 21 nt, Artificial Sequence
  Marburg virus siRNA sense strand
ugaggacuuugaugccucgaa

SEQ ID NO: 36924 - RNA, 21 nt, Artificial Sequence
  Marburg virus siRNA sense strand
gaggacuuugaugccucgaag

SEQ ID NO: 36925 - RNA, 21 nt, Artificial Sequence
  Marburg virus siRNA sense strand
aggacuuugaugccucgaagg

SEQ ID NO: 36926 - RNA, 21 nt, Artificial Sequence
  Marburg virus siRNA sense strand
ggacuuugaugccucgaaggu

SEQ ID NO: 36927 - RNA, 21 nt, Artificial Sequence
  Marburg virus siRNA sense strand
gacuuugaugccucgaaggua

SEQ ID NO: 36928 - RNA, 21 nt, Artificial Sequence
  Marburg virus siRNA sense strand
acuuugaugccucgaagguaa

SEQ ID NO: 36929 - RNA, 21 nt, Artificial Sequence
  Marburg virus siRNA sense strand
cuuugaugccucgaagguaau

SEQ ID NO: 36930 - RNA, 21 nt, Artificial Sequence
  Marburg virus siRNA sense strand
uuugaugccucgaagguaauc

SEQ ID NO: 36931 - RNA, 21 nt, Artificial Sequence
  Marburg virus siRNA sense strand
uugaugccucgaagguaaucu

SEQ ID NO: 36932 - RNA, 21 nt, Artificial Sequence
  Marburg virus siRNA sense strand
ugaugccucgaagguaaucuu

SEQ ID NO: 36933 - RNA, 21 nt, Artificial Sequence
  Marburg virus siRNA sense strand
gaugccucgaagguaaucuua

SEQ ID NO: 36934 - RNA, 21 nt, Artificial Sequence
  Marburg virus siRNA sense strand
augccucgaagguaaucuuaa

SEQ ID NO: 36935 - RNA, 21 nt, Artificial Sequence
  Marburg virus siRNA sense strand
ugccucgaagguaaucuuaaa

SEQ ID NO: 36936 - RNA, 21 nt, Artificial Sequence
  Marburg virus siRNA sense strand
gccucgaagguaaucuuaaau

SEQ ID NO: 36937 - RNA, 21 nt, Artificial Sequence
  Marburg virus siRNA sense strand
ccucgaagguaaucuuaaauu

SEQ ID NO: 36938 - RNA, 21 nt, Artificial Sequence
  Marburg virus siRNA sense strand
cucgaagguaaucuuaaauuc

SEQ ID NO: 36939 - RNA, 21 nt, Artificial Sequence
  Marburg virus siRNA sense strand
ucgaagguaaucuuaaauucu

SEQ ID NO: 36940 - RNA, 21 nt, Artificial Sequence
  Marburg virus siRNA sense strand
cgaagguaaucuuaaauucug

SEQ ID NO: 36941 - RNA, 21 nt, Artificial Sequence
  Marburg virus siRNA sense strand
gaagguaaucuuaaauucuga

SEQ ID NO: 36942 - RNA, 21 nt, Artificial Sequence
  Marburg virus siRNA sense strand
aagguaaucuuaaauucugaa

SEQ ID NO: 36943 - RNA, 21 nt, Artificial Sequence
  Marburg virus siRNA sense strand
agguaaucuuaaauucugaaa

SEQ ID NO: 36944 - RNA, 21 nt, Artificial Sequence
  Marburg virus siRNA sense strand
gguaaucuuaaauucugaaau

SEQ ID NO: 36945 - RNA, 21 nt, Artificial Sequence
  Marburg virus siRNA sense strand
guaaucuuaaauucugaaaua

SEQ ID NO: 36946 - RNA, 21 nt, Artificial Sequence
  Marburg virus siRNA sense strand
uaaucuuaaauucugaaauaa

SEQ ID NO: 36947 - RNA, 21 nt, Artificial Sequence
  Marburg virus siRNA sense strand
aaucuuaaauucugaaauaaa

SEQ ID NO: 36948 - RNA, 21 nt, Artificial Sequence
  Marburg virus siRNA sense strand
aucuuaaauucugaaauaaau

SEQ ID NO: 36949 - RNA, 21 nt, Artificial Sequence
  Marburg virus siRNA sense strand
ucuuaaauucugaaauaaaua

SEQ ID NO: 36950 - RNA, 21 nt, Artificial Sequence
  Marburg virus siRNA sense strand
cuuaaauucugaaauaaauaa

SEQ ID NO: 36951 - RNA, 21 nt, Artificial Sequence
  Marburg virus siRNA sense strand
uuaaauucugaaauaaauaac

SEQ ID NO: 36952 - RNA, 21 nt, Artificial Sequence
  Marburg virus siRNA sense strand
uaaauucugaaauaaauaacc

SEQ ID NO: 36953 - RNA, 21 nt, Artificial Sequence
  Marburg virus siRNA sense strand
aaauucugaaauaaauaaccu

SEQ ID NO: 36954 - RNA, 21 nt, Artificial Sequence
  Marburg virus siRNA sense strand
aauucugaaauaaauaaccuu

SEQ ID NO: 36955 - RNA, 21 nt, Artificial Sequence
  Marburg virus siRNA sense strand
auucugaaauaaauaaccuua

SEQ ID NO: 36956 - RNA, 21 nt, Artificial Sequence
  Marburg virus siRNA sense strand
uucugaaauaaauaaccuuaa

SEQ ID NO: 36957 - RNA, 21 nt, Artificial Sequence
  Marburg virus siRNA sense strand
ucugaaauaaauaaccuuaac

SEQ ID NO: 36958 - RNA, 21 nt, Artificial Sequence
  Marburg virus siRNA sense strand
cugaaauaaauaaccuuaacc

SEQ ID NO: 36959 - RNA, 21 nt, Artificial Sequence
  Marburg virus siRNA sense strand
ugaaauaaauaaccuuaaccu

SEQ ID NO: 36960 - RNA, 21 nt, Artificial Sequence
  Marburg virus siRNA sense strand
gaaauaaauaaccuuaaccuu

SEQ ID NO: 36961 - RNA, 21 nt, Artificial Sequence
  Marburg virus siRNA sense strand
aaauaaauaaccuuaaccuua

SEQ ID NO: 36962 - RNA, 21 nt, Artificial Sequence
  Marburg virus siRNA sense strand
aauaaauaaccuuaaccuuac

SEQ ID NO: 36963 - RNA, 21 nt, Artificial Sequence
  Marburg virus siRNA sense strand
auaaauaaccuuaaccuuacg

SEQ ID NO: 36964 - RNA, 21 nt, Artificial Sequence
  Marburg virus siRNA sense strand
uaaauaaccuuaaccuuacgg

SEQ ID NO: 36965 - RNA, 21 nt, Artificial Sequence
  Marburg virus siRNA sense strand
aaauaaccuuaaccuuacgga

SEQ ID NO: 36966 - RNA, 21 nt, Artificial Sequence
  Marburg virus siRNA sense strand
aauaaccuuaaccuuacggau

SEQ ID NO: 36967 - RNA, 21 nt, Artificial Sequence
  Marburg virus siRNA sense strand
auaaccuuaaccuuacggauu

SEQ ID NO: 36968 - RNA, 21 nt, Artificial Sequence
  Marburg virus siRNA sense strand
uaaccuuaaccuuacggauug

SEQ ID NO: 36969 - RNA, 21 nt, Artificial Sequence
  Marburg virus siRNA sense strand
aaccuuaaccuuacggauugu

SEQ ID NO: 36970 - RNA, 21 nt, Artificial Sequence
  Marburg virus siRNA sense strand
accuuaaccuuacggauugua

SEQ ID NO: 36971 - RNA, 21 nt, Artificial Sequence
  Marburg virus siRNA sense strand
ccuuaaccuuacggauuguac

SEQ ID NO: 36972 - RNA, 21 nt, Artificial Sequence
  Marburg virus siRNA sense strand
cuuaaccuuacggauuguacg

SEQ ID NO: 36973 - RNA, 21 nt, Artificial Sequence
  Marburg virus siRNA sense strand
uuaaccuuacggauuguacgc

SEQ ID NO: 36974 - RNA, 21 nt, Artificial Sequence
  Marburg virus siRNA sense strand
uaaccuuacggauuguacgcu

SEQ ID NO: 36975 - RNA, 21 nt, Artificial Sequence
  Marburg virus siRNA sense strand
aaccuuacggauuguacgcuu

SEQ ID NO: 36976 - RNA, 21 nt, Artificial Sequence
  Marburg virus siRNA sense strand
accuuacggauuguacgcuua

SEQ ID NO: 36977 - RNA, 21 nt, Artificial Sequence
  Marburg virus siRNA sense strand
ccuuacggauuguacgcuuaa

SEQ ID NO: 36978 - RNA, 21 nt, Artificial Sequence
  Marburg virus siRNA sense strand
cuuacggauuguacgcuuaau

SEQ ID NO: 36979 - RNA, 21 nt, Artificial Sequence
  Marburg virus siRNA sense strand
uuacggauuguacgcuuaaua

SEQ ID NO: 36980 - RNA, 21 nt, Artificial Sequence
  Marburg virus siRNA sense strand
uacggauuguacgcuuaauac

SEQ ID NO: 36981 - RNA, 21 nt, Artificial Sequence
  Marburg virus siRNA sense strand
acggauuguacgcuuaauaca

SEQ ID NO: 36982 - RNA, 21 nt, Artificial Sequence
  Marburg virus siRNA sense strand
cggauuguacgcuuaauacaa

SEQ ID NO: 36983 - RNA, 21 nt, Artificial Sequence
  Marburg virus siRNA sense strand
ggauuguacgcuuaauacaaa

SEQ ID NO: 36984 - RNA, 21 nt, Artificial Sequence
  Marburg virus siRNA sense strand
gauuguacgcuuaauacaaag

SEQ ID NO: 36985 - RNA, 21 nt, Artificial Sequence
  Marburg virus siRNA sense strand
auuguacgcuuaauacaaagu

SEQ ID NO: 36986 - RNA, 21 nt, Artificial Sequence
  Marburg virus siRNA sense strand
uuguacgcuuaauacaaaguc

SEQ ID NO: 36987 - RNA, 21 nt, Artificial Sequence
  Marburg virus siRNA sense strand
uguacgcuuaauacaaaguca

SEQ ID NO: 36988 - RNA, 21 nt, Artificial Sequence
  Marburg virus siRNA sense strand
guacgcuuaauacaaagucau

SEQ ID NO: 36989 - RNA, 21 nt, Artificial Sequence
  Marburg virus siRNA sense strand
uacgcuuaauacaaagucauu

SEQ ID NO: 36990 - RNA, 21 nt, Artificial Sequence
  Marburg virus siRNA sense strand
acgcuuaauacaaagucauug

SEQ ID NO: 36991 - RNA, 21 nt, Artificial Sequence
  Marburg virus siRNA sense strand
cgcuuaauacaaagucauuga

SEQ ID NO: 36992 - RNA, 21 nt, Artificial Sequence
  Marburg virus siRNA sense strand
gcuuaauacaaagucauugac

SEQ ID NO: 36993 - RNA, 21 nt, Artificial Sequence
  Marburg virus siRNA sense strand
cuuaauacaaagucauugaca

SEQ ID NO: 36994 - RNA, 21 nt, Artificial Sequence
  Marburg virus siRNA sense strand
uuaauacaaagucauugacaa

SEQ ID NO: 36995 - RNA, 21 nt, Artificial Sequence
  Marburg virus siRNA sense strand
uaauacaaagucauugacaac

SEQ ID NO: 36996 - RNA, 21 nt, Artificial Sequence
  Marburg virus siRNA sense strand
aauacaaagucauugacaacu

SEQ ID NO: 36997 - RNA, 21 nt, Artificial Sequence
  Marburg virus siRNA sense strand
auacaaagucauugacaacuc

SEQ ID NO: 36998 - RNA, 21 nt, Artificial Sequence
  Marburg virus siRNA sense strand
uacaaagucauugacaacucc

SEQ ID NO: 36999 - RNA, 21 nt, Artificial Sequence
  Marburg virus siRNA sense strand
acaaagucauugacaacuccu

SEQ ID NO: 37000 - RNA, 21 nt, Artificial Sequence
  Marburg virus siRNA sense strand
caaagucauugacaacuccua

SEQ ID NO: 37001 - RNA, 21 nt, Artificial Sequence
  Marburg virus siRNA sense strand
aaagucauugacaacuccuac

SEQ ID NO: 37002 - RNA, 21 nt, Artificial Sequence
  Marburg virus siRNA sense strand
aagucauugacaacuccuacc

SEQ ID NO: 37003 - RNA, 21 nt, Artificial Sequence
  Marburg virus siRNA sense strand
agucauugacaacuccuaccg

SEQ ID NO: 37004 - RNA, 21 nt, Artificial Sequence
  Marburg virus siRNA sense strand
gucauugacaacuccuaccgg

SEQ ID NO: 37005 - RNA, 21 nt, Artificial Sequence
  Marburg virus siRNA sense strand
ucauugacaacuccuaccggg

SEQ ID NO: 37006 - RNA, 21 nt, Artificial Sequence
  Marburg virus siRNA sense strand
cauugacaacuccuaccggga

SEQ ID NO: 37007 - RNA, 21 nt, Artificial Sequence
  Marburg virus siRNA sense strand
auugacaacuccuaccgggac

SEQ ID NO: 37008 - RNA, 21 nt, Artificial Sequence
  Marburg virus siRNA sense strand
uugacaacuccuaccgggaca

SEQ ID NO: 37009 - RNA, 21 nt, Artificial Sequence
  Marburg virus siRNA sense strand
ugacaacuccuaccgggacag

SEQ ID NO: 37010 - RNA, 21 nt, Artificial Sequence
  Marburg virus siRNA sense strand
gacaacuccuaccgggacaga

SEQ ID NO: 37011 - RNA, 21 nt, Artificial Sequence
  Marburg virus siRNA sense strand
acaacuccuaccgggacagaa

SEQ ID NO: 37012 - RNA, 21 nt, Artificial Sequence
  Marburg virus siRNA sense strand
caacuccuaccgggacagaaa

SEQ ID NO: 37013 - RNA, 21 nt, Artificial Sequence
  Marburg virus siRNA sense strand
aacuccuaccgggacagaaau

SEQ ID NO: 37014 - RNA, 21 nt, Artificial Sequence
  Marburg virus siRNA sense strand
acuccuaccgggacagaaauc

SEQ ID NO: 37015 - RNA, 21 nt, Artificial Sequence
  Marburg virus siRNA sense strand
cuccuaccgggacagaaaucu

SEQ ID NO: 37016 - RNA, 21 nt, Artificial Sequence
  Marburg virus siRNA sense strand
uccuaccgggacagaaaucuu

SEQ ID NO: 37017 - RNA, 21 nt, Artificial Sequence
  Marburg virus siRNA sense strand
ccuaccgggacagaaaucuua

SEQ ID NO: 37018 - RNA, 21 nt, Artificial Sequence
  Marburg virus siRNA sense strand
cuaccgggacagaaaucuuag

SEQ ID NO: 37019 - RNA, 21 nt, Artificial Sequence
  Marburg virus siRNA sense strand
uaccgggacagaaaucuuagg

SEQ ID NO: 37020 - RNA, 21 nt, Artificial Sequence
  Marburg virus siRNA sense strand
accgggacagaaaucuuaggu

SEQ ID NO: 37021 - RNA, 21 nt, Artificial Sequence
  Marburg virus siRNA sense strand
ccgggacagaaaucuuaggua

SEQ ID NO: 37022 - RNA, 21 nt, Artificial Sequence
  Marburg virus siRNA sense strand
cgggacagaaaucuuagguau

SEQ ID NO: 37023 - RNA, 21 nt, Artificial Sequence
  Marburg virus siRNA sense strand
gggacagaaaucuuagguaua

SEQ ID NO: 37024 - RNA, 21 nt, Artificial Sequence
  Marburg virus siRNA sense strand
ggacagaaaucuuagguauaa

SEQ ID NO: 37025 - RNA, 21 nt, Artificial Sequence
  Marburg virus siRNA sense strand
gacagaaaucuuagguauaag

SEQ ID NO: 37026 - RNA, 21 nt, Artificial Sequence
  Marburg virus siRNA sense strand
acagaaaucuuagguauaagu

SEQ ID NO: 37027 - RNA, 21 nt, Artificial Sequence
  Marburg virus siRNA sense strand
cagaaaucuuagguauaaguc

SEQ ID NO: 37028 - RNA, 21 nt, Artificial Sequence
  Marburg virus siRNA sense strand
agaaaucuuagguauaagucc

SEQ ID NO: 37029 - RNA, 21 nt, Artificial Sequence
  Marburg virus siRNA sense strand
gaaaucuuagguauaaguccg

SEQ ID NO: 37030 - RNA, 21 nt, Artificial Sequence
  Marburg virus siRNA sense strand
aaaucuuagguauaaguccgu

SEQ ID NO: 37031 - RNA, 21 nt, Artificial Sequence
  Marburg virus siRNA sense strand
aaucuuagguauaaguccguu

SEQ ID NO: 37032 - RNA, 21 nt, Artificial Sequence
  Marburg virus siRNA sense strand
aucuuagguauaaguccguuc

SEQ ID NO: 37033 - RNA, 21 nt, Artificial Sequence
  Marburg virus siRNA sense strand
ucuuagguauaaguccguuca

SEQ ID NO: 37034 - RNA, 21 nt, Artificial Sequence
  Marburg virus siRNA sense strand
cuuagguauaaguccguucag

SEQ ID NO: 37035 - RNA, 21 nt, Artificial Sequence
  Marburg virus siRNA sense strand
uuagguauaaguccguucaga

SEQ ID NO: 37036 - RNA, 21 nt, Artificial Sequence
  Marburg virus siRNA sense strand
uagguauaaguccguucagau

SEQ ID NO: 37037 - RNA, 21 nt, Artificial Sequence
  Marburg virus siRNA sense strand
agguauaaguccguucagauc

SEQ ID NO: 37038 - RNA, 21 nt, Artificial Sequence
  Marburg virus siRNA sense strand
gguauaaguccguucagaucc

SEQ ID NO: 37039 - RNA, 21 nt, Artificial Sequence
  Marburg virus siRNA sense strand
guauaaguccguucagauccu

SEQ ID NO: 37040 - RNA, 21 nt, Artificial Sequence
  Marburg virus siRNA sense strand
uauaaguccguucagauccuc

SEQ ID NO: 37041 - RNA, 21 nt, Artificial Sequence
  Marburg virus siRNA sense strand
auaaguccguucagauccucu

SEQ ID NO: 37042 - RNA, 21 nt, Artificial Sequence
  Marburg virus siRNA sense strand
uaaguccguucagauccucua

SEQ ID NO: 37043 - RNA, 21 nt, Artificial Sequence
  Marburg virus siRNA sense strand
aaguccguucagauccucuag

SEQ ID NO: 37044 - RNA, 21 nt, Artificial Sequence
  Marburg virus siRNA sense strand
aguccguucagauccucuaga

SEQ ID NO: 37045 - RNA, 21 nt, Artificial Sequence
  Marburg virus siRNA sense strand
guccguucagauccucuagau

SEQ ID NO: 37046 - RNA, 21 nt, Artificial Sequence
  Marburg virus siRNA sense strand
uccguucagauccucuagaua

SEQ ID NO: 37047 - RNA, 21 nt, Artificial Sequence
  Marburg virus siRNA sense strand
ccguucagauccucuagauau

SEQ ID NO: 37048 - RNA, 21 nt, Artificial Sequence
  Marburg virus siRNA sense strand
cguucagauccucuagauauu

SEQ ID NO: 37049 - RNA, 21 nt, Artificial Sequence
  Marburg virus siRNA sense strand
guucagauccucuagauauuc

SEQ ID NO: 37050 - RNA, 21 nt, Artificial Sequence
  Marburg virus siRNA sense strand
uucagauccucuagauauuca

SEQ ID NO: 37051 - RNA, 21 nt, Artificial Sequence
  Marburg virus siRNA sense strand
ucagauccucuagauauucau

SEQ ID NO: 37052 - RNA, 21 nt, Artificial Sequence
  Marburg virus siRNA sense strand
cagauccucuagauauucauc

SEQ ID NO: 37053 - RNA, 21 nt, Artificial Sequence
  Marburg virus siRNA sense strand
agauccucuagauauucauca

SEQ ID NO: 37054 - RNA, 21 nt, Artificial Sequence
  Marburg virus siRNA sense strand
gauccucuagauauucaucaa

SEQ ID NO: 37055 - RNA, 21 nt, Artificial Sequence
  Marburg virus siRNA sense strand
auccucuagauauucaucaac

SEQ ID NO: 37056 - RNA, 21 nt, Artificial Sequence
  Marburg virus siRNA sense strand
uccucuagauauucaucaacu

SEQ ID NO: 37057 - RNA, 21 nt, Artificial Sequence
  Marburg virus siRNA sense strand
ccucuagauauucaucaacuu

SEQ ID NO: 37058 - RNA, 21 nt, Artificial Sequence
  Marburg virus siRNA sense strand
cucuagauauucaucaacuuc

SEQ ID NO: 37059 - RNA, 21 nt, Artificial Sequence
  Marburg virus siRNA sense strand
ucuagauauucaucaacuucc

SEQ ID NO: 37060 - RNA, 21 nt, Artificial Sequence
  Marburg virus siRNA sense strand
cuagauauucaucaacuucca

SEQ ID NO: 37061 - RNA, 21 nt, Artificial Sequence
  Marburg virus siRNA sense strand
uagauauucaucaacuuccag

SEQ ID NO: 37062 - RNA, 21 nt, Artificial Sequence
  Marburg virus siRNA sense strand
agauauucaucaacuuccagg

SEQ ID NO: 37063 - RNA, 21 nt, Artificial Sequence
  Marburg virus siRNA sense strand
gauauucaucaacuuccaggg

SEQ ID NO: 37064 - RNA, 21 nt, Artificial Sequence
  Marburg virus siRNA sense strand
auauucaucaacuuccaggga

SEQ ID NO: 37065 - RNA, 21 nt, Artificial Sequence
  Marburg virus siRNA sense strand
uauucaucaacuuccagggaa

SEQ ID NO: 37066 - RNA, 21 nt, Artificial Sequence
  Marburg virus siRNA sense strand
auucaucaacuuccagggaac

SEQ ID NO: 37067 - RNA, 21 nt, Artificial Sequence
  Marburg virus siRNA sense strand
uucaucaacuuccagggaacg

SEQ ID NO: 37068 - RNA, 21 nt, Artificial Sequence
  Marburg virus siRNA sense strand
ucaucaacuuccagggaacgg

SEQ ID NO: 37069 - RNA, 21 nt, Artificial Sequence
  Marburg virus siRNA sense strand
caucaacuuccagggaacggu

SEQ ID NO: 37070 - RNA, 21 nt, Artificial Sequence
  Marburg virus siRNA sense strand
aucaacuuccagggaacgguc

SEQ ID NO: 37071 - RNA, 21 nt, Artificial Sequence
  Marburg virus siRNA sense strand
ucaacuuccagggaacggucu

SEQ ID NO: 37072 - RNA, 21 nt, Artificial Sequence
  Marburg virus siRNA sense strand
caacuuccagggaacggucuc

SEQ ID NO: 37073 - RNA, 21 nt, Artificial Sequence
  Marburg virus siRNA sense strand
aacuuccagggaacggucucg

SEQ ID NO: 37074 - RNA, 21 nt, Artificial Sequence
  Marburg virus siRNA sense strand
acuuccagggaacggucucga

SEQ ID NO: 37075 - RNA, 21 nt, Artificial Sequence
  Marburg virus siRNA sense strand
cuuccagggaacggucucgac

SEQ ID NO: 37076 - RNA, 21 nt, Artificial Sequence
  Marburg virus siRNA sense strand
uuccagggaacggucucgacu

SEQ ID NO: 37077 - RNA, 21 nt, Artificial Sequence
  Marburg virus siRNA sense strand
uccagggaacggucucgacua

SEQ ID NO: 37078 - RNA, 21 nt, Artificial Sequence
  Marburg virus siRNA sense strand
ccagggaacggucucgacuau

SEQ ID NO: 37079 - RNA, 21 nt, Artificial Sequence
  Marburg virus siRNA sense strand
cagggaacggucucgacuauc

SEQ ID NO: 37080 - RNA, 21 nt, Artificial Sequence
  Marburg virus siRNA sense strand
agggaacggucucgacuaucu

SEQ ID NO: 37081 - RNA, 21 nt, Artificial Sequence
  Marburg virus siRNA sense strand
gggaacggucucgacuaucua

SEQ ID NO: 37082 - RNA, 21 nt, Artificial Sequence
  Marburg virus siRNA sense strand
ggaacggucucgacuaucuag

SEQ ID NO: 37083 - RNA, 21 nt, Artificial Sequence
  Marburg virus siRNA sense strand
gaacggucucgacuaucuaga

SEQ ID NO: 37084 - RNA, 21 nt, Artificial Sequence
  Marburg virus siRNA sense strand
aacggucucgacuaucuagag

SEQ ID NO: 37085 - RNA, 21 nt, Artificial Sequence
  Marburg virus siRNA sense strand
acggucucgacuaucuagaga

SEQ ID NO: 37086 - RNA, 21 nt, Artificial Sequence
  Marburg virus siRNA sense strand
cggucucgacuaucuagagaa

SEQ ID NO: 37087 - RNA, 21 nt, Artificial Sequence
  Marburg virus siRNA sense strand
ggucucgacuaucuagagaac

SEQ ID NO: 37088 - RNA, 21 nt, Artificial Sequence
  Marburg virus siRNA sense strand
gucucgacuaucuagagaaca

SEQ ID NO: 37089 - RNA, 21 nt, Artificial Sequence
  Marburg virus siRNA sense strand
ucucgacuaucuagagaacaa

SEQ ID NO: 37090 - RNA, 21 nt, Artificial Sequence
  Marburg virus siRNA sense strand
cucgacuaucuagagaacaag

SEQ ID NO: 37091 - RNA, 21 nt, Artificial Sequence
  Marburg virus siRNA sense strand
ucgacuaucuagagaacaagc

SEQ ID NO: 37092 - RNA, 21 nt, Artificial Sequence
  Marburg virus siRNA sense strand
cgacuaucuagagaacaagcu

SEQ ID NO: 37093 - RNA, 21 nt, Artificial Sequence
  Marburg virus siRNA sense strand
gacuaucuagagaacaagcuu

SEQ ID NO: 37094 - RNA, 21 nt, Artificial Sequence
  Marburg virus siRNA sense strand
acuaucuagagaacaagcuuc

SEQ ID NO: 37095 - RNA, 21 nt, Artificial Sequence
  Marburg virus siRNA sense strand
cuaucuagagaacaagcuuca

SEQ ID NO: 37096 - RNA, 21 nt, Artificial Sequence
  Marburg virus siRNA sense strand
uaucuagagaacaagcuucau

SEQ ID NO: 37097 - RNA, 21 nt, Artificial Sequence
  Marburg virus siRNA sense strand
aucuagagaacaagcuucaua

SEQ ID NO: 37098 - RNA, 21 nt, Artificial Sequence
  Marburg virus siRNA sense strand
ucuagagaacaagcuucauau

SEQ ID NO: 37099 - RNA, 21 nt, Artificial Sequence
  Marburg virus siRNA sense strand
cuagagaacaagcuucauauu

SEQ ID NO: 37100 - RNA, 21 nt, Artificial Sequence
  Marburg virus siRNA sense strand
uagagaacaagcuucauauuu

SEQ ID NO: 37101 - RNA, 21 nt, Artificial Sequence
  Marburg virus siRNA sense strand
agagaacaagcuucauauuug

SEQ ID NO: 37102 - RNA, 21 nt, Artificial Sequence
  Marburg virus siRNA sense strand
gagaacaagcuucauauuugu

SEQ ID NO: 37103 - RNA, 21 nt, Artificial Sequence
  Marburg virus siRNA sense strand
agaacaagcuucauauuugua

SEQ ID NO: 37104 - RNA, 21 nt, Artificial Sequence
  Marburg virus siRNA sense strand
gaacaagcuucauauuuguau

SEQ ID NO: 37105 - RNA, 21 nt, Artificial Sequence
  Marburg virus siRNA sense strand
aacaagcuucauauuuguaug

SEQ ID NO: 37106 - RNA, 21 nt, Artificial Sequence
  Marburg virus siRNA sense strand
acaagcuucauauuuguaugu

SEQ ID NO: 37107 - RNA, 21 nt, Artificial Sequence
  Marburg virus siRNA sense strand
caagcuucauauuuguauguu

SEQ ID NO: 37108 - RNA, 21 nt, Artificial Sequence
  Marburg virus siRNA sense strand
aagcuucauauuuguauguug

SEQ ID NO: 37109 - RNA, 21 nt, Artificial Sequence
  Marburg virus siRNA sense strand
agcuucauauuuguauguuga

SEQ ID NO: 37110 - RNA, 21 nt, Artificial Sequence
  Marburg virus siRNA sense strand
gcuucauauuuguauguugau

SEQ ID NO: 37111 - RNA, 21 nt, Artificial Sequence
  Marburg virus siRNA sense strand
cuucauauuuguauguugauu

SEQ ID NO: 37112 - RNA, 21 nt, Artificial Sequence
  Marburg virus siRNA sense strand
uucauauuuguauguugauug

SEQ ID NO: 37113 - RNA, 21 nt, Artificial Sequence
  Marburg virus siRNA sense strand
ucauauuuguauguugauugc

SEQ ID NO: 37114 - RNA, 21 nt, Artificial Sequence
  Marburg virus siRNA sense strand
cauauuuguauguugauugca

SEQ ID NO: 37115 - RNA, 21 nt, Artificial Sequence
  Marburg virus siRNA sense strand
auauuuguauguugauugcag

SEQ ID NO: 37116 - RNA, 21 nt, Artificial Sequence
  Marburg virus siRNA sense strand
uauuuguauguugauugcagu

SEQ ID NO: 37117 - RNA, 21 nt, Artificial Sequence
  Marburg virus siRNA sense strand
auuuguauguugauugcagua

SEQ ID NO: 37118 - RNA, 21 nt, Artificial Sequence
  Marburg virus siRNA sense strand
uuuguauguugauugcaguaa

SEQ ID NO: 37119 - RNA, 21 nt, Artificial Sequence
  Marburg virus siRNA sense strand
uuguauguugauugcaguaau

SEQ ID NO: 37120 - RNA, 21 nt, Artificial Sequence
  Marburg virus siRNA sense strand
uguauguugauugcaguaaua

SEQ ID NO: 37121 - RNA, 21 nt, Artificial Sequence
  Marburg virus siRNA sense strand
guauguugauugcaguaauau

SEQ ID NO: 37122 - RNA, 21 nt, Artificial Sequence
  Marburg virus siRNA sense strand
uauguugauugcaguaauauu

SEQ ID NO: 37123 - RNA, 21 nt, Artificial Sequence
  Marburg virus siRNA sense strand
auguugauugcaguaauauuc

SEQ ID NO: 37124 - RNA, 21 nt, Artificial Sequence
  Marburg virus siRNA sense strand
uguugauugcaguaauauucc

SEQ ID NO: 37125 - RNA, 21 nt, Artificial Sequence
  Marburg virus siRNA sense strand
guugauugcaguaauauuccc

SEQ ID NO: 37126 - RNA, 21 nt, Artificial Sequence
  Marburg virus siRNA sense strand
uugauugcaguaauauucccu

SEQ ID NO: 37127 - RNA, 21 nt, Artificial Sequence
  Marburg virus siRNA sense strand
ugauugcaguaauauucccuc

SEQ ID NO: 37128 - RNA, 21 nt, Artificial Sequence
  Marburg virus siRNA sense strand
gauugcaguaauauucccucu

SEQ ID NO: 37129 - RNA, 21 nt, Artificial Sequence
  Marburg virus siRNA sense strand
auugcaguaauauucccucua

SEQ ID NO: 37130 - RNA, 21 nt, Artificial Sequence
  Marburg virus siRNA sense strand
uugcaguaauauucccucuau

SEQ ID NO: 37131 - RNA, 21 nt, Artificial Sequence
  Marburg virus siRNA sense strand
ugcaguaauauucccucuauc

SEQ ID NO: 37132 - RNA, 21 nt, Artificial Sequence
  Marburg virus siRNA sense strand
gcaguaauauucccucuaucu

SEQ ID NO: 37133 - RNA, 21 nt, Artificial Sequence
  Marburg virus siRNA sense strand
caguaauauucccucuaucuc

SEQ ID NO: 37134 - RNA, 21 nt, Artificial Sequence
  Marburg virus siRNA sense strand
aguaauauucccucuaucucu

SEQ ID NO: 37135 - RNA, 21 nt, Artificial Sequence
  Marburg virus siRNA sense strand
guaauauucccucuaucucuc

SEQ ID NO: 37136 - RNA, 21 nt, Artificial Sequence
  Marburg virus siRNA sense strand
uaauauucccucuaucucucu

SEQ ID NO: 37137 - RNA, 21 nt, Artificial Sequence
  Marburg virus siRNA sense strand
aauauucccucuaucucucua

SEQ ID NO: 37138 - RNA, 21 nt, Artificial Sequence
  Marburg virus siRNA sense strand
auauucccucuaucucucuag

SEQ ID NO: 37139 - RNA, 21 nt, Artificial Sequence
  Marburg virus siRNA sense strand
uauucccucuaucucucuaga

SEQ ID NO: 37140 - RNA, 21 nt, Artificial Sequence
  Marburg virus siRNA sense strand
auucccucuaucucucuagac

SEQ ID NO: 37141 - RNA, 21 nt, Artificial Sequence
  Marburg virus siRNA sense strand
uucccucuaucucucuagacc

SEQ ID NO: 37142 - RNA, 21 nt, Artificial Sequence
  Marburg virus siRNA sense strand
ucccucuaucucucuagaccc

SEQ ID NO: 37143 - RNA, 21 nt, Artificial Sequence
  Marburg virus siRNA sense strand
cccucuaucucucuagacccg

SEQ ID NO: 37144 - RNA, 21 nt, Artificial Sequence
  Marburg virus siRNA sense strand
ccucuaucucucuagacccgg

SEQ ID NO: 37145 - RNA, 21 nt, Artificial Sequence
  Marburg virus siRNA sense strand
cucuaucucucuagacccggg

SEQ ID NO: 37146 - RNA, 21 nt, Artificial Sequence
  Marburg virus siRNA sense strand
ucuaucucucuagacccgggu

SEQ ID NO: 37147 - RNA, 21 nt, Artificial Sequence
  Marburg virus siRNA sense strand
cuaucucucuagacccggguu

SEQ ID NO: 37148 - RNA, 21 nt, Artificial Sequence
  Marburg virus siRNA sense strand
uaucucucuagacccggguuu

SEQ ID NO: 37149 - RNA, 21 nt, Artificial Sequence
  Marburg virus siRNA sense strand
aucucucuagacccggguuuu

SEQ ID NO: 37150 - RNA, 21 nt, Artificial Sequence
  Marburg virus siRNA sense strand
ucucucuagacccggguuuuc

SEQ ID NO: 37151 - RNA, 21 nt, Artificial Sequence
  Marburg virus siRNA sense strand
cucucuagacccggguuuuca

SEQ ID NO: 37152 - RNA, 21 nt, Artificial Sequence
  Marburg virus siRNA sense strand
ucucuagacccggguuuucag

SEQ ID NO: 37153 - RNA, 21 nt, Artificial Sequence
  Marburg virus siRNA sense strand
cucuagacccggguuuucaga

SEQ ID NO: 37154 - RNA, 21 nt, Artificial Sequence
  Marburg virus siRNA sense strand
ucuagacccggguuuucagaa

SEQ ID NO: 37155 - RNA, 21 nt, Artificial Sequence
  Marburg virus siRNA sense strand
cuagacccggguuuucagaau

SEQ ID NO: 37156 - RNA, 21 nt, Artificial Sequence
  Marburg virus siRNA sense strand
uagacccggguuuucagaaua

SEQ ID NO: 37157 - RNA, 21 nt, Artificial Sequence
  Marburg virus siRNA sense strand
agacccggguuuucagaauau

SEQ ID NO: 37158 - RNA, 21 nt, Artificial Sequence
  Marburg virus siRNA sense strand
gacccggguuuucagaauaug

SEQ ID NO: 37159 - RNA, 21 nt, Artificial Sequence
  Marburg virus siRNA sense strand
acccggguuuucagaauaugu

SEQ ID NO: 37160 - RNA, 21 nt, Artificial Sequence
  Marburg virus siRNA sense strand
cccggguuuucagaauauguc

SEQ ID NO: 37161 - RNA, 21 nt, Artificial Sequence
  Marburg virus siRNA sense strand
ccggguuuucagaauaugucu

SEQ ID NO: 37162 - RNA, 21 nt, Artificial Sequence
  Marburg virus siRNA sense strand
cggguuuucagaauaugucug

SEQ ID NO: 37163 - RNA, 21 nt, Artificial Sequence
  Marburg virus siRNA sense strand
ggguuuucagaauaugucuga

SEQ ID NO: 37164 - RNA, 21 nt, Artificial Sequence
  Marburg virus siRNA sense strand
gguuuucagaauaugucugau

SEQ ID NO: 37165 - RNA, 21 nt, Artificial Sequence
  Marburg virus siRNA sense strand
guuuucagaauaugucugauc

SEQ ID NO: 37166 - RNA, 21 nt, Artificial Sequence
  Marburg virus siRNA sense strand
uuuucagaauaugucugauca

SEQ ID NO: 37167 - RNA, 21 nt, Artificial Sequence
  Marburg virus siRNA sense strand
uuucagaauaugucugaucag

SEQ ID NO: 37168 - RNA, 21 nt, Artificial Sequence
  Marburg virus siRNA sense strand
uucagaauaugucugaucaga

SEQ ID NO: 37169 - RNA, 21 nt, Artificial Sequence
  Marburg virus siRNA sense strand
ucagaauaugucugaucagaa

SEQ ID NO: 37170 - RNA, 21 nt, Artificial Sequence
  Marburg virus siRNA sense strand
cagaauaugucugaucagaau

SEQ ID NO: 37171 - RNA, 21 nt, Artificial Sequence
  Marburg virus siRNA sense strand
agaauaugucugaucagaauc

SEQ ID NO: 37172 - RNA, 21 nt, Artificial Sequence
  Marburg virus siRNA sense strand
gaauaugucugaucagaauca

SEQ ID NO: 37173 - RNA, 21 nt, Artificial Sequence
  Marburg virus siRNA sense strand
aauaugucugaucagaaucaa

SEQ ID NO: 37174 - RNA, 21 nt, Artificial Sequence
  Marburg virus siRNA sense strand
auaugucugaucagaaucaag

SEQ ID NO: 37175 - RNA, 21 nt, Artificial Sequence
  Marburg virus siRNA sense strand
uaugucugaucagaaucaagu

SEQ ID NO: 37176 - RNA, 21 nt, Artificial Sequence
  Marburg virus siRNA sense strand
augucugaucagaaucaaguu

SEQ ID NO: 37177 - RNA, 21 nt, Artificial Sequence
  Marburg virus siRNA sense strand
ugucugaucagaaucaaguuc

SEQ ID NO: 37178 - RNA, 21 nt, Artificial Sequence
  Marburg virus siRNA sense strand
gucugaucagaaucaaguuca

SEQ ID NO: 37179 - RNA, 21 nt, Artificial Sequence
  Marburg virus siRNA sense strand
ucugaucagaaucaaguucaa

SEQ ID NO: 37180 - RNA, 21 nt, Artificial Sequence
  Marburg virus siRNA sense strand
cugaucagaaucaaguucaaa

SEQ ID NO: 37181 - RNA, 21 nt, Artificial Sequence
  Marburg virus siRNA sense strand
ugaucagaaucaaguucaaau

SEQ ID NO: 37182 - RNA, 21 nt, Artificial Sequence
  Marburg virus siRNA sense strand
gaucagaaucaaguucaaaug

SEQ ID NO: 37183 - RNA, 21 nt, Artificial Sequence
  Marburg virus siRNA sense strand
aucagaaucaaguucaaaugu

SEQ ID NO: 37184 - RNA, 21 nt, Artificial Sequence
  Marburg virus siRNA sense strand
ucagaaucaaguucaaauguu

SEQ ID NO: 37185 - RNA, 21 nt, Artificial Sequence
  Marburg virus siRNA sense strand
cagaaucaaguucaaauguua

SEQ ID NO: 37186 - RNA, 21 nt, Artificial Sequence
  Marburg virus siRNA sense strand
agaaucaaguucaaauguuaa

SEQ ID NO: 37187 - RNA, 21 nt, Artificial Sequence
  Marburg virus siRNA sense strand
gaaucaaguucaaauguuaau

SEQ ID NO: 37188 - RNA, 21 nt, Artificial Sequence
  Marburg virus siRNA sense strand
aaucaaguucaaauguuaauc

SEQ ID NO: 37189 - RNA, 21 nt, Artificial Sequence
  Marburg virus siRNA sense strand
aucaaguucaaauguuaauca

SEQ ID NO: 37190 - RNA, 21 nt, Artificial Sequence
  Marburg virus siRNA sense strand
ucaaguucaaauguuaaucaa

SEQ ID NO: 37191 - RNA, 21 nt, Artificial Sequence
  Marburg virus siRNA sense strand
caaguucaaauguuaaucaau

SEQ ID NO: 37192 - RNA, 21 nt, Artificial Sequence
  Marburg virus siRNA sense strand
aaguucaaauguuaaucaaua

SEQ ID NO: 37193 - RNA, 21 nt, Artificial Sequence
  Marburg virus siRNA sense strand
aguucaaauguuaaucaauac

SEQ ID NO: 37194 - RNA, 21 nt, Artificial Sequence
  Marburg virus siRNA sense strand
guucaaauguuaaucaauacc

SEQ ID NO: 37195 - RNA, 21 nt, Artificial Sequence
  Marburg virus siRNA sense strand
uucaaauguuaaucaauaccu

SEQ ID NO: 37196 - RNA, 21 nt, Artificial Sequence
  Marburg virus siRNA sense strand
ucaaauguuaaucaauaccua

SEQ ID NO: 37197 - RNA, 21 nt, Artificial Sequence
  Marburg virus siRNA sense strand
caaauguuaaucaauaccuac

SEQ ID NO: 37198 - RNA, 21 nt, Artificial Sequence
  Marburg virus siRNA sense strand
aaauguuaaucaauaccuaca

SEQ ID NO: 37199 - RNA, 21 nt, Artificial Sequence
  Marburg virus siRNA sense strand
aauguuaaucaauaccuacaa

SEQ ID NO: 37200 - RNA, 21 nt, Artificial Sequence
  Marburg virus siRNA sense strand
auguuaaucaauaccuacaaa

SEQ ID NO: 37201 - RNA, 21 nt, Artificial Sequence
  Marburg virus siRNA sense strand
uguuaaucaauaccuacaaac

SEQ ID NO: 37202 - RNA, 21 nt, Artificial Sequence
  Marburg virus siRNA sense strand
guuaaucaauaccuacaaacg

SEQ ID NO: 37203 - RNA, 21 nt, Artificial Sequence
  Marburg virus siRNA sense strand
uuaaucaauaccuacaaacgu

SEQ ID NO: 37204 - RNA, 21 nt, Artificial Sequence
  Marburg virus siRNA sense strand
uaaucaauaccuacaaacgug

SEQ ID NO: 37205 - RNA, 21 nt, Artificial Sequence
  Marburg virus siRNA sense strand
aaucaauaccuacaaacguga

SEQ ID NO: 37206 - RNA, 21 nt, Artificial Sequence
  Marburg virus siRNA sense strand
aucaauaccuacaaacgugau

SEQ ID NO: 37207 - RNA, 21 nt, Artificial Sequence
  Marburg virus siRNA sense strand
ucaauaccuacaaacgugauu

SEQ ID NO: 37208 - RNA, 21 nt, Artificial Sequence
  Marburg virus siRNA sense strand
caauaccuacaaacgugauuu

SEQ ID NO: 37209 - RNA, 21 nt, Artificial Sequence
  Marburg virus siRNA sense strand
aauaccuacaaacgugauuua

SEQ ID NO: 37210 - RNA, 21 nt, Artificial Sequence
  Marburg virus siRNA sense strand
auaccuacaaacgugauuuac

SEQ ID NO: 37211 - RNA, 21 nt, Artificial Sequence
  Marburg virus siRNA sense strand
uaccuacaaacgugauuuaca

SEQ ID NO: 37212 - RNA, 21 nt, Artificial Sequence
  Marburg virus siRNA sense strand
accuacaaacgugauuuacau

SEQ ID NO: 37213 - RNA, 21 nt, Artificial Sequence
  Marburg virus siRNA sense strand
ccuacaaacgugauuuacaug

SEQ ID NO: 37214 - RNA, 21 nt, Artificial Sequence
  Marburg virus siRNA sense strand
cuacaaacgugauuuacaugc

SEQ ID NO: 37215 - RNA, 21 nt, Artificial Sequence
  Marburg virus siRNA sense strand
uacaaacgugauuuacaugcu

SEQ ID NO: 37216 - RNA, 21 nt, Artificial Sequence
  Marburg virus siRNA sense strand
acaaacgugauuuacaugcuu

SEQ ID NO: 37217 - RNA, 21 nt, Artificial Sequence
  Marburg virus siRNA sense strand
caaacgugauuuacaugcuug

SEQ ID NO: 37218 - RNA, 21 nt, Artificial Sequence
  Marburg virus siRNA sense strand
aaacgugauuuacaugcuugu

SEQ ID NO: 37219 - RNA, 21 nt, Artificial Sequence
  Marburg virus siRNA sense strand
aacgugauuuacaugcuuguu

SEQ ID NO: 37220 - RNA, 21 nt, Artificial Sequence
  Marburg virus siRNA sense strand
acgugauuuacaugcuuguuu

SEQ ID NO: 37221 - RNA, 21 nt, Artificial Sequence
  Marburg virus siRNA sense strand
cgugauuuacaugcuuguuuu

SEQ ID NO: 37222 - RNA, 21 nt, Artificial Sequence
  Marburg virus siRNA sense strand
gugauuuacaugcuuguuuug

SEQ ID NO: 37223 - RNA, 21 nt, Artificial Sequence
  Marburg virus siRNA sense strand
ugauuuacaugcuuguuuuga

SEQ ID NO: 37224 - RNA, 21 nt, Artificial Sequence
  Marburg virus siRNA sense strand
gauuuacaugcuuguuuugau

SEQ ID NO: 37225 - RNA, 21 nt, Artificial Sequence
  Marburg virus siRNA sense strand
auuuacaugcuuguuuugaua

SEQ ID NO: 37226 - RNA, 21 nt, Artificial Sequence
  Marburg virus siRNA sense strand
uuuacaugcuuguuuugauag

SEQ ID NO: 37227 - RNA, 21 nt, Artificial Sequence
  Marburg virus siRNA sense strand
uuacaugcuuguuuugauagc

SEQ ID NO: 37228 - RNA, 21 nt, Artificial Sequence
  Marburg virus siRNA sense strand
uacaugcuuguuuugauagca

SEQ ID NO: 37229 - RNA, 21 nt, Artificial Sequence
  Marburg virus siRNA sense strand
acaugcuuguuuugauagcaa

SEQ ID NO: 37230 - RNA, 21 nt, Artificial Sequence
  Marburg virus siRNA sense strand
caugcuuguuuugauagcaau

SEQ ID NO: 37231 - RNA, 21 nt, Artificial Sequence
  Marburg virus siRNA sense strand
augcuuguuuugauagcaauc

SEQ ID NO: 37232 - RNA, 21 nt, Artificial Sequence
  Marburg virus siRNA sense strand
ugcuuguuuugauagcaauca

SEQ ID NO: 37233 - RNA, 21 nt, Artificial Sequence
  Marburg virus siRNA sense strand
gcuuguuuugauagcaaucaa

SEQ ID NO: 37234 - RNA, 21 nt, Artificial Sequence
  Marburg virus siRNA sense strand
cuuguuuugauagcaaucaau

SEQ ID NO: 37235 - RNA, 21 nt, Artificial Sequence
  Marburg virus siRNA sense strand
uuguuuugauagcaaucaauu

SEQ ID NO: 37236 - RNA, 21 nt, Artificial Sequence
  Marburg virus siRNA sense strand
uguuuugauagcaaucaauuc

SEQ ID NO: 37237 - RNA, 21 nt, Artificial Sequence
  Marburg virus siRNA sense strand
guuuugauagcaaucaauucu

SEQ ID NO: 37238 - RNA, 21 nt, Artificial Sequence
  Marburg virus siRNA sense strand
uuuugauagcaaucaauucug

SEQ ID NO: 37239 - RNA, 21 nt, Artificial Sequence
  Marburg virus siRNA sense strand
uuugauagcaaucaauucugu

SEQ ID NO: 37240 - RNA, 21 nt, Artificial Sequence
  Marburg virus siRNA sense strand
uugauagcaaucaauucuguc

SEQ ID NO: 37241 - RNA, 21 nt, Artificial Sequence
  Marburg virus siRNA sense strand
ugauagcaaucaauucugucg

SEQ ID NO: 37242 - RNA, 21 nt, Artificial Sequence
  Marburg virus siRNA sense strand
gauagcaaucaauucugucgg

SEQ ID NO: 37243 - RNA, 21 nt, Artificial Sequence
  Marburg virus siRNA sense strand
auagcaaucaauucugucggu

SEQ ID NO: 37244 - RNA, 21 nt, Artificial Sequence
  Marburg virus siRNA sense strand
uagcaaucaauucugucgguu

SEQ ID NO: 37245 - RNA, 21 nt, Artificial Sequence
  Marburg virus siRNA sense strand
agcaaucaauucugucgguuu

SEQ ID NO: 37246 - RNA, 21 nt, Artificial Sequence
  Marburg virus siRNA sense strand
gcaaucaauucugucgguuua

SEQ ID NO: 37247 - RNA, 21 nt, Artificial Sequence
  Marburg virus siRNA sense strand
caaucaauucugucgguuuac

SEQ ID NO: 37248 - RNA, 21 nt, Artificial Sequence
  Marburg virus siRNA sense strand
aaucaauucugucgguuuaca

SEQ ID NO: 37249 - RNA, 21 nt, Artificial Sequence
  Marburg virus siRNA sense strand
aucaauucugucgguuuacag

SEQ ID NO: 37250 - RNA, 21 nt, Artificial Sequence
  Marburg virus siRNA sense strand
ucaauucugucgguuuacagg

SEQ ID NO: 37251 - RNA, 21 nt, Artificial Sequence
  Marburg virus siRNA sense strand
caauucugucgguuuacaggg

SEQ ID NO: 37252 - RNA, 21 nt, Artificial Sequence
  Marburg virus siRNA sense strand
aauucugucgguuuacagggg

SEQ ID NO: 37253 - RNA, 21 nt, Artificial Sequence
  Marburg virus siRNA sense strand
auucugucgguuuacaggggu

SEQ ID NO: 37254 - RNA, 21 nt, Artificial Sequence
  Marburg virus siRNA sense strand
uucugucgguuuacaggggua

SEQ ID NO: 37255 - RNA, 21 nt, Artificial Sequence
  Marburg virus siRNA sense strand
ucugucgguuuacagggguag

SEQ ID NO: 37256 - RNA, 21 nt, Artificial Sequence
  Marburg virus siRNA sense strand
cugucgguuuacagggguagu

SEQ ID NO: 37257 - RNA, 21 nt, Artificial Sequence
  Marburg virus siRNA sense strand
ugucgguuuacagggguaguc

SEQ ID NO: 37258 - RNA, 21 nt, Artificial Sequence
  Marburg virus siRNA sense strand
gucgguuuacagggguagucu

SEQ ID NO: 37259 - RNA, 21 nt, Artificial Sequence
  Marburg virus siRNA sense strand
ucgguuuacagggguagucuc

SEQ ID NO: 37260 - RNA, 21 nt, Artificial Sequence
  Marburg virus siRNA sense strand
cgguuuacagggguagucuca

SEQ ID NO: 37261 - RNA, 21 nt, Artificial Sequence
  Marburg virus siRNA sense strand
gguuuacagggguagucucau

SEQ ID NO: 37262 - RNA, 21 nt, Artificial Sequence
  Marburg virus siRNA sense strand
guuuacagggguagucucauc

SEQ ID NO: 37263 - RNA, 21 nt, Artificial Sequence
  Marburg virus siRNA sense strand
uuuacagggguagucucauca

SEQ ID NO: 37264 - RNA, 21 nt, Artificial Sequence
  Marburg virus siRNA sense strand
uuacagggguagucucaucaa

SEQ ID NO: 37265 - RNA, 21 nt, Artificial Sequence
  Marburg virus siRNA sense strand
uacagggguagucucaucaau

SEQ ID NO: 37266 - RNA, 21 nt, Artificial Sequence
  Marburg virus siRNA sense strand
acagggguagucucaucaaug

SEQ ID NO: 37267 - RNA, 21 nt, Artificial Sequence
  Marburg virus siRNA sense strand
cagggguagucucaucaaugc

SEQ ID NO: 37268 - RNA, 21 nt, Artificial Sequence
  Marburg virus siRNA sense strand
agggguagucucaucaaugca

SEQ ID NO: 37269 - RNA, 21 nt, Artificial Sequence
  Marburg virus siRNA sense strand
gggguagucucaucaaugcau

SEQ ID NO: 37270 - RNA, 21 nt, Artificial Sequence
  Marburg virus siRNA sense strand
ggguagucucaucaaugcauu

SEQ ID NO: 37271 - RNA, 21 nt, Artificial Sequence
  Marburg virus siRNA sense strand
gguagucucaucaaugcauua

SEQ ID NO: 37272 - RNA, 21 nt, Artificial Sequence
  Marburg virus siRNA sense strand
guagucucaucaaugcauuac

SEQ ID NO: 37273 - RNA, 21 nt, Artificial Sequence
  Marburg virus siRNA sense strand
uagucucaucaaugcauuaca

SEQ ID NO: 37274 - RNA, 21 nt, Artificial Sequence
  Marburg virus siRNA sense strand
agucucaucaaugcauuacaa

SEQ ID NO: 37275 - RNA, 21 nt, Artificial Sequence
  Marburg virus siRNA sense strand
gucucaucaaugcauuacaag

SEQ ID NO: 37276 - RNA, 21 nt, Artificial Sequence
  Marburg virus siRNA sense strand
ucucaucaaugcauuacaagc

SEQ ID NO: 37277 - RNA, 21 nt, Artificial Sequence
  Marburg virus siRNA sense strand
cucaucaaugcauuacaagcu

SEQ ID NO: 37278 - RNA, 21 nt, Artificial Sequence
  Marburg virus siRNA sense strand
ucaucaaugcauuacaagcuu

SEQ ID NO: 37279 - RNA, 21 nt, Artificial Sequence
  Marburg virus siRNA sense strand
caucaaugcauuacaagcuuu

SEQ ID NO: 37280 - RNA, 21 nt, Artificial Sequence
  Marburg virus siRNA sense strand
aucaaugcauuacaagcuuua

SEQ ID NO: 37281 - RNA, 21 nt, Artificial Sequence
  Marburg virus siRNA sense strand
ucaaugcauuacaagcuuuau

SEQ ID NO: 37282 - RNA, 21 nt, Artificial Sequence
  Marburg virus siRNA sense strand
caaugcauuacaagcuuuaug

SEQ ID NO: 37283 - RNA, 21 nt, Artificial Sequence
  Marburg virus siRNA sense strand
aaugcauuacaagcuuuauga

SEQ ID NO: 37284 - RNA, 21 nt, Artificial Sequence
  Marburg virus siRNA sense strand
augcauuacaagcuuuaugau

SEQ ID NO: 37285 - RNA, 21 nt, Artificial Sequence
  Marburg virus siRNA sense strand
ugcauuacaagcuuuaugauc

SEQ ID NO: 37286 - RNA, 21 nt, Artificial Sequence
  Marburg virus siRNA sense strand
gcauuacaagcuuuaugaucu

SEQ ID NO: 37287 - RNA, 21 nt, Artificial Sequence
  Marburg virus siRNA sense strand
cauuacaagcuuuaugaucuc

SEQ ID NO: 37288 - RNA, 21 nt, Artificial Sequence
  Marburg virus siRNA sense strand
auuacaagcuuuaugaucucu

SEQ ID NO: 37289 - RNA, 21 nt, Artificial Sequence
  Marburg virus siRNA sense strand
uuacaagcuuuaugaucucuu

SEQ ID NO: 37290 - RNA, 21 nt, Artificial Sequence
  Marburg virus siRNA sense strand
uacaagcuuuaugaucucuug

SEQ ID NO: 37291 - RNA, 21 nt, Artificial Sequence
  Marburg virus siRNA sense strand
acaagcuuuaugaucucuugc

SEQ ID NO: 37292 - RNA, 21 nt, Artificial Sequence
  Marburg virus siRNA sense strand
caagcuuuaugaucucuugcc

SEQ ID NO: 37293 - RNA, 21 nt, Artificial Sequence
  Marburg virus siRNA sense strand
aagcuuuaugaucucuugccu

SEQ ID NO: 37294 - RNA, 21 nt, Artificial Sequence
  Marburg virus siRNA sense strand
agcuuuaugaucucuugccuc

SEQ ID NO: 37295 - RNA, 21 nt, Artificial Sequence
  Marburg virus siRNA sense strand
gcuuuaugaucucuugccucc

SEQ ID NO: 37296 - RNA, 21 nt, Artificial Sequence
  Marburg virus siRNA sense strand
cuuuaugaucucuugccucca

SEQ ID NO: 37297 - RNA, 21 nt, Artificial Sequence
  Marburg virus siRNA sense strand
uuuaugaucucuugccuccag

SEQ ID NO: 37298 - RNA, 21 nt, Artificial Sequence
  Marburg virus siRNA sense strand
uuaugaucucuugccuccagg

SEQ ID NO: 37299 - RNA, 21 nt, Artificial Sequence
  Marburg virus siRNA sense strand
uaugaucucuugccuccaggu

SEQ ID NO: 37300 - RNA, 21 nt, Artificial Sequence
  Marburg virus siRNA sense strand
augaucucuugccuccaggug

SEQ ID NO: 37301 - RNA, 21 nt, Artificial Sequence
  Marburg virus siRNA sense strand
ugaucucuugccuccagguga

SEQ ID NO: 37302 - RNA, 21 nt, Artificial Sequence
  Marburg virus siRNA sense strand
gaucucuugccuccaggugaa

SEQ ID NO: 37303 - RNA, 21 nt, Artificial Sequence
  Marburg virus siRNA sense strand
aucucuugccuccaggugaau

SEQ ID NO: 37304 - RNA, 21 nt, Artificial Sequence
  Marburg virus siRNA sense strand
ucucuugccuccaggugaauu

SEQ ID NO: 37305 - RNA, 21 nt, Artificial Sequence
  Marburg virus siRNA sense strand
cucuugccuccaggugaauug

SEQ ID NO: 37306 - RNA, 21 nt, Artificial Sequence
  Marburg virus siRNA sense strand
ucuugccuccaggugaauuga

SEQ ID NO: 37307 - RNA, 21 nt, Artificial Sequence
  Marburg virus siRNA sense strand
cuugccuccaggugaauugag

SEQ ID NO: 37308 - RNA, 21 nt, Artificial Sequence
  Marburg virus siRNA sense strand
uugccuccaggugaauugaga

SEQ ID NO: 37309 - RNA, 21 nt, Artificial Sequence
  Marburg virus siRNA sense strand
ugccuccaggugaauugagaa

SEQ ID NO: 37310 - RNA, 21 nt, Artificial Sequence
  Marburg virus siRNA sense strand
gccuccaggugaauugagaaa

SEQ ID NO: 37311 - RNA, 21 nt, Artificial Sequence
  Marburg virus siRNA sense strand
ccuccaggugaauugagaaag

SEQ ID NO: 37312 - RNA, 21 nt, Artificial Sequence
  Marburg virus siRNA sense strand
cuccaggugaauugagaaagg

SEQ ID NO: 37313 - RNA, 21 nt, Artificial Sequence
  Marburg virus siRNA sense strand
uccaggugaauugagaaaggc

SEQ ID NO: 37314 - RNA, 21 nt, Artificial Sequence
  Marburg virus siRNA sense strand
ccaggugaauugagaaaggca

SEQ ID NO: 37315 - RNA, 21 nt, Artificial Sequence
  Marburg virus siRNA sense strand
caggugaauugagaaaggcaa

SEQ ID NO: 37316 - RNA, 21 nt, Artificial Sequence
  Marburg virus siRNA sense strand
aggugaauugagaaaggcaau

SEQ ID NO: 37317 - RNA, 21 nt, Artificial Sequence
  Marburg virus siRNA sense strand
ggugaauugagaaaggcaauu

SEQ ID NO: 37318 - RNA, 21 nt, Artificial Sequence
  Marburg virus siRNA sense strand
gugaauugagaaaggcaauuu

SEQ ID NO: 37319 - RNA, 21 nt, Artificial Sequence
  Marburg virus siRNA sense strand
ugaauugagaaaggcaauuug

SEQ ID NO: 37320 - RNA, 21 nt, Artificial Sequence
  Marburg virus siRNA sense strand
gaauugagaaaggcaauuugc

SEQ ID NO: 37321 - RNA, 21 nt, Artificial Sequence
  Marburg virus siRNA sense strand
aauugagaaaggcaauuugcu

SEQ ID NO: 37322 - RNA, 21 nt, Artificial Sequence
  Marburg virus siRNA sense strand
auugagaaaggcaauuugcuu

SEQ ID NO: 37323 - RNA, 21 nt, Artificial Sequence
  Marburg virus siRNA sense strand
uugagaaaggcaauuugcuug

SEQ ID NO: 37324 - RNA, 21 nt, Artificial Sequence
  Marburg virus siRNA sense strand
ugagaaaggcaauuugcuugg

SEQ ID NO: 37325 - RNA, 21 nt, Artificial Sequence
  Marburg virus siRNA sense strand
gagaaaggcaauuugcuuggc

SEQ ID NO: 37326 - RNA, 21 nt, Artificial Sequence
  Marburg virus siRNA sense strand
agaaaggcaauuugcuuggcc

SEQ ID NO: 37327 - RNA, 21 nt, Artificial Sequence
  Marburg virus siRNA sense strand
gaaaggcaauuugcuuggccg

SEQ ID NO: 37328 - RNA, 21 nt, Artificial Sequence
  Marburg virus siRNA sense strand
aaaggcaauuugcuuggccga

SEQ ID NO: 37329 - RNA, 21 nt, Artificial Sequence
  Marburg virus siRNA sense strand
aaggcaauuugcuuggccgaa

SEQ ID NO: 37330 - RNA, 21 nt, Artificial Sequence
  Marburg virus siRNA sense strand
aggcaauuugcuuggccgaag

SEQ ID NO: 37331 - RNA, 21 nt, Artificial Sequence
  Marburg virus siRNA sense strand
ggcaauuugcuuggccgaagg

SEQ ID NO: 37332 - RNA, 21 nt, Artificial Sequence
  Marburg virus siRNA sense strand
gcaauuugcuuggccgaagga

SEQ ID NO: 37333 - RNA, 21 nt, Artificial Sequence
  Marburg virus siRNA sense strand
caauuugcuuggccgaaggag

SEQ ID NO: 37334 - RNA, 21 nt, Artificial Sequence
  Marburg virus siRNA sense strand
aauuugcuuggccgaaggaga

SEQ ID NO: 37335 - RNA, 21 nt, Artificial Sequence
  Marburg virus siRNA sense strand
auuugcuuggccgaaggagaa

SEQ ID NO: 37336 - RNA, 21 nt, Artificial Sequence
  Marburg virus siRNA sense strand
uuugcuuggccgaaggagaag

SEQ ID NO: 37337 - RNA, 21 nt, Artificial Sequence
  Marburg virus siRNA sense strand
uugcuuggccgaaggagaagg

SEQ ID NO: 37338 - RNA, 21 nt, Artificial Sequence
  Marburg virus siRNA sense strand
ugcuuggccgaaggagaagga

SEQ ID NO: 37339 - RNA, 21 nt, Artificial Sequence
  Marburg virus siRNA sense strand
gcuuggccgaaggagaaggaa

SEQ ID NO: 37340 - RNA, 21 nt, Artificial Sequence
  Marburg virus siRNA sense strand
cuuggccgaaggagaaggaag

SEQ ID NO: 37341 - RNA, 21 nt, Artificial Sequence
  Marburg virus siRNA sense strand
uuggccgaaggagaaggaagu

SEQ ID NO: 37342 - RNA, 21 nt, Artificial Sequence
  Marburg virus siRNA sense strand
uggccgaaggagaaggaagug

SEQ ID NO: 37343 - RNA, 21 nt, Artificial Sequence
  Marburg virus siRNA sense strand
ggccgaaggagaaggaagugg

SEQ ID NO: 37344 - RNA, 21 nt, Artificial Sequence
  Marburg virus siRNA sense strand
gccgaaggagaaggaaguggu

SEQ ID NO: 37345 - RNA, 21 nt, Artificial Sequence
  Marburg virus siRNA sense strand
ccgaaggagaaggaaguggug

SEQ ID NO: 37346 - RNA, 21 nt, Artificial Sequence
  Marburg virus siRNA sense strand
cgaaggagaaggaaguggugc

SEQ ID NO: 37347 - RNA, 21 nt, Artificial Sequence
  Marburg virus siRNA sense strand
gaaggagaaggaaguggugcu

SEQ ID NO: 37348 - RNA, 21 nt, Artificial Sequence
  Marburg virus siRNA sense strand
aaggagaaggaaguggugcuc

SEQ ID NO: 37349 - RNA, 21 nt, Artificial Sequence
  Marburg virus siRNA sense strand
aggagaaggaaguggugcucg

SEQ ID NO: 37350 - RNA, 21 nt, Artificial Sequence
  Marburg virus siRNA sense strand
ggagaaggaaguggugcucgg

SEQ ID NO: 37351 - RNA, 21 nt, Artificial Sequence
  Marburg virus siRNA sense strand
gagaaggaaguggugcucggu

SEQ ID NO: 37352 - RNA, 21 nt, Artificial Sequence
  Marburg virus siRNA sense strand
agaaggaaguggugcucgguu

SEQ ID NO: 37353 - RNA, 21 nt, Artificial Sequence
  Marburg virus siRNA sense strand
gaaggaaguggugcucgguua

SEQ ID NO: 37354 - RNA, 21 nt, Artificial Sequence
  Marburg virus siRNA sense strand
aaggaaguggugcucgguuac

SEQ ID NO: 37355 - RNA, 21 nt, Artificial Sequence
  Marburg virus siRNA sense strand
aggaaguggugcucgguuacu

SEQ ID NO: 37356 - RNA, 21 nt, Artificial Sequence
  Marburg virus siRNA sense strand
ggaaguggugcucgguuacuu

SEQ ID NO: 37357 - RNA, 21 nt, Artificial Sequence
  Marburg virus siRNA sense strand
gaaguggugcucgguuacuuu

SEQ ID NO: 37358 - RNA, 21 nt, Artificial Sequence
  Marburg virus siRNA sense strand
aaguggugcucgguuacuuuu

SEQ ID NO: 37359 - RNA, 21 nt, Artificial Sequence
  Marburg virus siRNA sense strand
aguggugcucgguuacuuuug

SEQ ID NO: 37360 - RNA, 21 nt, Artificial Sequence
  Marburg virus siRNA sense strand
guggugcucgguuacuuuuga

SEQ ID NO: 37361 - RNA, 21 nt, Artificial Sequence
  Marburg virus siRNA sense strand
uggugcucgguuacuuuugaa

SEQ ID NO: 37362 - RNA, 21 nt, Artificial Sequence
  Marburg virus siRNA sense strand
ggugcucgguuacuuuugaag

SEQ ID NO: 37363 - RNA, 21 nt, Artificial Sequence
  Marburg virus siRNA sense strand
gugcucgguuacuuuugaagu

SEQ ID NO: 37364 - RNA, 21 nt, Artificial Sequence
  Marburg virus siRNA sense strand
ugcucgguuacuuuugaagug

SEQ ID NO: 37365 - RNA, 21 nt, Artificial Sequence
  Marburg virus siRNA sense strand
gcucgguuacuuuugaagugg

SEQ ID NO: 37366 - RNA, 21 nt, Artificial Sequence
  Marburg virus siRNA sense strand
cucgguuacuuuugaagugga

SEQ ID NO: 37367 - RNA, 21 nt, Artificial Sequence
  Marburg virus siRNA sense strand
ucgguuacuuuugaaguggaa

SEQ ID NO: 37368 - RNA, 21 nt, Artificial Sequence
  Marburg virus siRNA sense strand
cgguuacuuuugaaguggaag

SEQ ID NO: 37369 - RNA, 21 nt, Artificial Sequence
  Marburg virus siRNA sense strand
gguuacuuuugaaguggaaga

SEQ ID NO: 37370 - RNA, 21 nt, Artificial Sequence
  Marburg virus siRNA sense strand
guuacuuuugaaguggaagaa

SEQ ID NO: 37371 - RNA, 21 nt, Artificial Sequence
  Marburg virus siRNA sense strand
uuacuuuugaaguggaagaag

SEQ ID NO: 37372 - RNA, 21 nt, Artificial Sequence
  Marburg virus siRNA sense strand
uacuuuugaaguggaagaaga

SEQ ID NO: 37373 - RNA, 21 nt, Artificial Sequence
  Marburg virus siRNA sense strand
acuuuugaaguggaagaagac

SEQ ID NO: 37374 - RNA, 21 nt, Artificial Sequence
  Marburg virus siRNA sense strand
cuuuugaaguggaagaagacg

SEQ ID NO: 37375 - RNA, 21 nt, Artificial Sequence
  Marburg virus siRNA sense strand
uuuugaaguggaagaagacgg

SEQ ID NO: 37376 - RNA, 21 nt, Artificial Sequence
  Marburg virus siRNA sense strand
uuugaaguggaagaagacgga

SEQ ID NO: 37377 - RNA, 21 nt, Artificial Sequence
  Marburg virus siRNA sense strand
uugaaguggaagaagacggau

SEQ ID NO: 37378 - RNA, 21 nt, Artificial Sequence
  Marburg virus siRNA sense strand
ugaaguggaagaagacggauu

SEQ ID NO: 37379 - RNA, 21 nt, Artificial Sequence
  Marburg virus siRNA sense strand
gaaguggaagaagacggauua

SEQ ID NO: 37380 - RNA, 21 nt, Artificial Sequence
  Marburg virus siRNA sense strand
aaguggaagaagacggauuau

SEQ ID NO: 37381 - RNA, 21 nt, Artificial Sequence
  Marburg virus siRNA sense strand
aguggaagaagacggauuauu

SEQ ID NO: 37382 - RNA, 21 nt, Artificial Sequence
  Marburg virus siRNA sense strand
guggaagaagacggauuauuu

SEQ ID NO: 37383 - RNA, 21 nt, Artificial Sequence
  Marburg virus siRNA sense strand
uggaagaagacggauuauuua

SEQ ID NO: 37384 - RNA, 21 nt, Artificial Sequence
  Marburg virus siRNA sense strand
ggaagaagacggauuauuuau

SEQ ID NO: 37385 - RNA, 21 nt, Artificial Sequence
  Marburg virus siRNA sense strand
gaagaagacggauuauuuauu

SEQ ID NO: 37386 - RNA, 21 nt, Artificial Sequence
  Marburg virus siRNA sense strand
aagaagacggauuauuuauuu

SEQ ID NO: 37387 - RNA, 21 nt, Artificial Sequence
  Marburg virus siRNA sense strand
agaagacggauuauuuauuuu

SEQ ID NO: 37388 - RNA, 21 nt, Artificial Sequence
  Marburg virus siRNA sense strand
gaagacggauuauuuauuuuu

SEQ ID NO: 37389 - RNA, 21 nt, Artificial Sequence
  Marburg virus siRNA sense strand
aagacggauuauuuauuuuuc

SEQ ID NO: 37390 - RNA, 21 nt, Artificial Sequence
  Marburg virus siRNA sense strand
agacggauuauuuauuuuuca

SEQ ID NO: 37391 - RNA, 21 nt, Artificial Sequence
  Marburg virus siRNA sense strand
gacggauuauuuauuuuucaa

SEQ ID NO: 37392 - RNA, 21 nt, Artificial Sequence
  Marburg virus siRNA sense strand
acggauuauuuauuuuucaac

SEQ ID NO: 37393 - RNA, 21 nt, Artificial Sequence
  Marburg virus siRNA sense strand
cggauuauuuauuuuucaaca

SEQ ID NO: 37394 - RNA, 21 nt, Artificial Sequence
  Marburg virus siRNA sense strand
ggauuauuuauuuuucaacac

SEQ ID NO: 37395 - RNA, 21 nt, Artificial Sequence
  Marburg virus siRNA sense strand
gauuauuuauuuuucaacacu

SEQ ID NO: 37396 - RNA, 21 nt, Artificial Sequence
  Marburg virus siRNA sense strand
auuauuuauuuuucaacacuu

SEQ ID NO: 37397 - RNA, 21 nt, Artificial Sequence
  Marburg virus siRNA sense strand
uuauuuauuuuucaacacuuu

SEQ ID NO: 37398 - RNA, 21 nt, Artificial Sequence
  Marburg virus siRNA sense strand
uauuuauuuuucaacacuuug

SEQ ID NO: 37399 - RNA, 21 nt, Artificial Sequence
  Marburg virus siRNA sense strand
auuuauuuuucaacacuuugg

SEQ ID NO: 37400 - RNA, 21 nt, Artificial Sequence
  Marburg virus siRNA sense strand
uuuauuuuucaacacuuuggc

SEQ ID NO: 37401 - RNA, 21 nt, Artificial Sequence
  Marburg virus siRNA sense strand
uuauuuuucaacacuuuggcu

SEQ ID NO: 37402 - RNA, 21 nt, Artificial Sequence
  Marburg virus siRNA sense strand
uauuuuucaacacuuuggcua

SEQ ID NO: 37403 - RNA, 21 nt, Artificial Sequence
  Marburg virus siRNA sense strand
auuuuucaacacuuuggcuac

SEQ ID NO: 37404 - RNA, 21 nt, Artificial Sequence
  Marburg virus siRNA sense strand
uuuuucaacacuuuggcuacg

SEQ ID NO: 37405 - RNA, 21 nt, Artificial Sequence
  Marburg virus siRNA sense strand
uuuucaacacuuuggcuacgg

SEQ ID NO: 37406 - RNA, 21 nt, Artificial Sequence
  Marburg virus siRNA sense strand
uuucaacacuuuggcuacgga

SEQ ID NO: 37407 - RNA, 21 nt, Artificial Sequence
  Marburg virus siRNA sense strand
uucaacacuuuggcuacggau

SEQ ID NO: 37408 - RNA, 21 nt, Artificial Sequence
  Marburg virus siRNA sense strand
ucaacacuuuggcuacggauu

SEQ ID NO: 37409 - RNA, 21 nt, Artificial Sequence
  Marburg virus siRNA sense strand
caacacuuuggcuacggauuc

SEQ ID NO: 37410 - RNA, 21 nt, Artificial Sequence
  Marburg virus siRNA sense strand
aacacuuuggcuacggauuca

SEQ ID NO: 37411 - RNA, 21 nt, Artificial Sequence
  Marburg virus siRNA sense strand
acacuuuggcuacggauucac

SEQ ID NO: 37412 - RNA, 21 nt, Artificial Sequence
  Marburg virus siRNA sense strand
cacuuuggcuacggauucaca

SEQ ID NO: 37413 - RNA, 21 nt, Artificial Sequence
  Marburg virus siRNA sense strand
acuuuggcuacggauucacag

SEQ ID NO: 37414 - RNA, 21 nt, Artificial Sequence
  Marburg virus siRNA sense strand
cuuuggcuacggauucacagc

SEQ ID NO: 37415 - RNA, 21 nt, Artificial Sequence
  Marburg virus siRNA sense strand
uuuggcuacggauucacagca

SEQ ID NO: 37416 - RNA, 21 nt, Artificial Sequence
  Marburg virus siRNA sense strand
uuggcuacggauucacagcaa

SEQ ID NO: 37417 - RNA, 21 nt, Artificial Sequence
  Marburg virus siRNA sense strand
uggcuacggauucacagcaag

SEQ ID NO: 37418 - RNA, 21 nt, Artificial Sequence
  Marburg virus siRNA sense strand
ggcuacggauucacagcaaga

SEQ ID NO: 37419 - RNA, 21 nt, Artificial Sequence
  Marburg virus siRNA sense strand
gcuacggauucacagcaagaa

SEQ ID NO: 37420 - RNA, 21 nt, Artificial Sequence
  Marburg virus siRNA sense strand
cuacggauucacagcaagaag

SEQ ID NO: 37421 - RNA, 21 nt, Artificial Sequence
  Marburg virus siRNA sense strand
uacggauucacagcaagaagc

SEQ ID NO: 37422 - RNA, 21 nt, Artificial Sequence
  Marburg virus siRNA sense strand
acggauucacagcaagaagca

SEQ ID NO: 37423 - RNA, 21 nt, Artificial Sequence
  Marburg virus siRNA sense strand
cggauucacagcaagaagcag

SEQ ID NO: 37424 - RNA, 21 nt, Artificial Sequence
  Marburg virus siRNA sense strand
ggauucacagcaagaagcaga

SEQ ID NO: 37425 - RNA, 21 nt, Artificial Sequence
  Marburg virus siRNA sense strand
gauucacagcaagaagcagag

SEQ ID NO: 37426 - RNA, 21 nt, Artificial Sequence
  Marburg virus siRNA sense strand
auucacagcaagaagcagaga

SEQ ID NO: 37427 - RNA, 21 nt, Artificial Sequence
  Marburg virus siRNA sense strand
uucacagcaagaagcagagau

SEQ ID NO: 37428 - RNA, 21 nt, Artificial Sequence
  Marburg virus siRNA sense strand
ucacagcaagaagcagagauu

SEQ ID NO: 37429 - RNA, 21 nt, Artificial Sequence
  Marburg virus siRNA sense strand
cacagcaagaagcagagauuu

SEQ ID NO: 37430 - RNA, 21 nt, Artificial Sequence
  Marburg virus siRNA sense strand
acagcaagaagcagagauuuu

SEQ ID NO: 37431 - RNA, 21 nt, Artificial Sequence
  Marburg virus siRNA sense strand
cagcaagaagcagagauuuua

SEQ ID NO: 37432 - RNA, 21 nt, Artificial Sequence
  Marburg virus siRNA sense strand
agcaagaagcagagauuuuaa

SEQ ID NO: 37433 - RNA, 21 nt, Artificial Sequence
  Marburg virus siRNA sense strand
gcaagaagcagagauuuuaag

SEQ ID NO: 37434 - RNA, 21 nt, Artificial Sequence
  Marburg virus siRNA sense strand
caagaagcagagauuuuaagu

SEQ ID NO: 37435 - RNA, 21 nt, Artificial Sequence
  Marburg virus siRNA sense strand
aagaagcagagauuuuaagug

SEQ ID NO: 37436 - RNA, 21 nt, Artificial Sequence
  Marburg virus siRNA sense strand
agaagcagagauuuuaagugg

SEQ ID NO: 37437 - RNA, 21 nt, Artificial Sequence
  Marburg virus siRNA sense strand
gaagcagagauuuuaaguggc

SEQ ID NO: 37438 - RNA, 21 nt, Artificial Sequence
  Marburg virus siRNA sense strand
aagcagagauuuuaaguggcc

SEQ ID NO: 37439 - RNA, 21 nt, Artificial Sequence
  Marburg virus siRNA sense strand
agcagagauuuuaaguggccg

SEQ ID NO: 37440 - RNA, 21 nt, Artificial Sequence
  Marburg virus siRNA sense strand
gcagagauuuuaaguggccgg

SEQ ID NO: 37441 - RNA, 21 nt, Artificial Sequence
  Marburg virus siRNA sense strand
cagagauuuuaaguggccggg

SEQ ID NO: 37442 - RNA, 21 nt, Artificial Sequence
  Marburg virus siRNA sense strand
agagauuuuaaguggccgggu

SEQ ID NO: 37443 - RNA, 21 nt, Artificial Sequence
  Marburg virus siRNA sense strand
gagauuuuaaguggccgggua

SEQ ID NO: 37444 - RNA, 21 nt, Artificial Sequence
  Marburg virus siRNA sense strand
agauuuuaaguggccggguaa

SEQ ID NO: 37445 - RNA, 21 nt, Artificial Sequence
  Marburg virus siRNA sense strand
gauuuuaaguggccggguaau

SEQ ID NO: 37446 - RNA, 21 nt, Artificial Sequence
  Marburg virus siRNA sense strand
auuuuaaguggccggguaaua

SEQ ID NO: 37447 - RNA, 21 nt, Artificial Sequence
  Marburg virus siRNA sense strand
uuuuaaguggccggguaauac

SEQ ID NO: 37448 - RNA, 21 nt, Artificial Sequence
  Marburg virus siRNA sense strand
uuuaaguggccggguaauacc

SEQ ID NO: 37449 - RNA, 21 nt, Artificial Sequence
  Marburg virus siRNA sense strand
uuaaguggccggguaauaccg

SEQ ID NO: 37450 - RNA, 21 nt, Artificial Sequence
  Marburg virus siRNA sense strand
uaaguggccggguaauaccga

SEQ ID NO: 37451 - RNA, 21 nt, Artificial Sequence
  Marburg virus siRNA sense strand
aaguggccggguaauaccgag

SEQ ID NO: 37452 - RNA, 21 nt, Artificial Sequence
  Marburg virus siRNA sense strand
aguggccggguaauaccgaga

SEQ ID NO: 37453 - RNA, 21 nt, Artificial Sequence
  Marburg virus siRNA sense strand
guggccggguaauaccgagaa

SEQ ID NO: 37454 - RNA, 21 nt, Artificial Sequence
  Marburg virus siRNA sense strand
uggccggguaauaccgagaau

SEQ ID NO: 37455 - RNA, 21 nt, Artificial Sequence
  Marburg virus siRNA sense strand
ggccggguaauaccgagaaug

SEQ ID NO: 37456 - RNA, 21 nt, Artificial Sequence
  Marburg virus siRNA sense strand
gccggguaauaccgagaaugu

SEQ ID NO: 37457 - RNA, 21 nt, Artificial Sequence
  Marburg virus siRNA sense strand
ccggguaauaccgagaauguu

SEQ ID NO: 37458 - RNA, 21 nt, Artificial Sequence
  Marburg virus siRNA sense strand
cggguaauaccgagaauguua

SEQ ID NO: 37459 - RNA, 21 nt, Artificial Sequence
  Marburg virus siRNA sense strand
ggguaauaccgagaauguuau

SEQ ID NO: 37460 - RNA, 21 nt, Artificial Sequence
  Marburg virus siRNA sense strand
gguaauaccgagaauguuaua

SEQ ID NO: 37461 - RNA, 21 nt, Artificial Sequence
  Marburg virus siRNA sense strand
guaauaccgagaauguuauau

SEQ ID NO: 37462 - RNA, 21 nt, Artificial Sequence
  Marburg virus siRNA sense strand
uaauaccgagaauguuauaua

SEQ ID NO: 37463 - RNA, 21 nt, Artificial Sequence
  Marburg virus siRNA sense strand
aauaccgagaauguuauauaa

SEQ ID NO: 37464 - RNA, 21 nt, Artificial Sequence
  Marburg virus siRNA sense strand
auaccgagaauguuauauaac

SEQ ID NO: 37465 - RNA, 21 nt, Artificial Sequence
  Marburg virus siRNA sense strand
uaccgagaauguuauauaaca

SEQ ID NO: 37466 - RNA, 21 nt, Artificial Sequence
  Marburg virus siRNA sense strand
accgagaauguuauauaacau

SEQ ID NO: 37467 - RNA, 21 nt, Artificial Sequence
  Marburg virus siRNA sense strand
ccgagaauguuauauaacaua

SEQ ID NO: 37468 - RNA, 21 nt, Artificial Sequence
  Marburg virus siRNA sense strand
cgagaauguuauauaacauag

SEQ ID NO: 37469 - RNA, 21 nt, Artificial Sequence
  Marburg virus siRNA sense strand
gagaauguuauauaacauaga

SEQ ID NO: 37470 - RNA, 21 nt, Artificial Sequence
  Marburg virus siRNA sense strand
agaauguuauauaacauagau

SEQ ID NO: 37471 - RNA, 21 nt, Artificial Sequence
  Marburg virus siRNA sense strand
gaauguuauauaacauagaua

SEQ ID NO: 37472 - RNA, 21 nt, Artificial Sequence
  Marburg virus siRNA sense strand
aauguuauauaacauagauag

SEQ ID NO: 37473 - RNA, 21 nt, Artificial Sequence
  Marburg virus siRNA sense strand
auguuauauaacauagauagg

SEQ ID NO: 37474 - RNA, 21 nt, Artificial Sequence
  Marburg virus siRNA sense strand
uguuauauaacauagauaggu

SEQ ID NO: 37475 - RNA, 21 nt, Artificial Sequence
  Marburg virus siRNA sense strand
guuauauaacauagauagguu

SEQ ID NO: 37476 - RNA, 21 nt, Artificial Sequence
  Marburg virus siRNA sense strand
uuauauaacauagauagguua

SEQ ID NO: 37477 - RNA, 21 nt, Artificial Sequence
  Marburg virus siRNA sense strand
uauauaacauagauagguuaa

SEQ ID NO: 37478 - RNA, 21 nt, Artificial Sequence
  Marburg virus siRNA sense strand
auauaacauagauagguuaaa

SEQ ID NO: 37479 - RNA, 21 nt, Artificial Sequence
  Marburg virus siRNA sense strand
uauaacauagauagguuaaau

SEQ ID NO: 37480 - RNA, 21 nt, Artificial Sequence
  Marburg virus siRNA sense strand
auaacauagauagguuaaaug

SEQ ID NO: 37481 - RNA, 21 nt, Artificial Sequence
  Marburg virus siRNA sense strand
uaacauagauagguuaaaugc

SEQ ID NO: 37482 - RNA, 21 nt, Artificial Sequence
  Marburg virus siRNA sense strand
aacauagauagguuaaaugcu

SEQ ID NO: 37483 - RNA, 21 nt, Artificial Sequence
  Marburg virus siRNA sense strand
acauagauagguuaaaugcuu

SEQ ID NO: 37484 - RNA, 21 nt, Artificial Sequence
  Marburg virus siRNA sense strand
cauagauagguuaaaugcuuu

SEQ ID NO: 37485 - RNA, 21 nt, Artificial Sequence
  Marburg virus siRNA sense strand
auagauagguuaaaugcuuug

SEQ ID NO: 37486 - RNA, 21 nt, Artificial Sequence
  Marburg virus siRNA sense strand
uagauagguuaaaugcuuugc

SEQ ID NO: 37487 - RNA, 21 nt, Artificial Sequence
  Marburg virus siRNA sense strand
agauagguuaaaugcuuugcu

SEQ ID NO: 37488 - RNA, 21 nt, Artificial Sequence
  Marburg virus siRNA sense strand
gauagguuaaaugcuuugcuu

SEQ ID NO: 37489 - RNA, 21 nt, Artificial Sequence
  Marburg virus siRNA sense strand
auagguuaaaugcuuugcuug

SEQ ID NO: 37490 - RNA, 21 nt, Artificial Sequence
  Marburg virus siRNA sense strand
uagguuaaaugcuuugcuuga

SEQ ID NO: 37491 - RNA, 21 nt, Artificial Sequence
  Marburg virus siRNA sense strand
agguuaaaugcuuugcuugaa

SEQ ID NO: 37492 - RNA, 21 nt, Artificial Sequence
  Marburg virus siRNA sense strand
gguuaaaugcuuugcuugaau

SEQ ID NO: 37493 - RNA, 21 nt, Artificial Sequence
  Marburg virus siRNA sense strand
guuaaaugcuuugcuugaauc

SEQ ID NO: 37494 - RNA, 21 nt, Artificial Sequence
  Marburg virus siRNA sense strand
uuaaaugcuuugcuugaauca

SEQ ID NO: 37495 - RNA, 21 nt, Artificial Sequence
  Marburg virus siRNA sense strand
uaaaugcuuugcuugaaucaa

SEQ ID NO: 37496 - RNA, 21 nt, Artificial Sequence
  Marburg virus siRNA sense strand
aaaugcuuugcuugaaucaag

SEQ ID NO: 37497 - RNA, 21 nt, Artificial Sequence
  Marburg virus siRNA sense strand
aaugcuuugcuugaaucaaga

SEQ ID NO: 37498 - RNA, 21 nt, Artificial Sequence
  Marburg virus siRNA sense strand
augcuuugcuugaaucaagaa

SEQ ID NO: 37499 - RNA, 21 nt, Artificial Sequence
  Marburg virus siRNA sense strand
ugcuuugcuugaaucaagaag

SEQ ID NO: 37500 - RNA, 21 nt, Artificial Sequence
  Marburg virus siRNA sense strand
gcuuugcuugaaucaagaaga

SEQ ID NO: 37501 - RNA, 21 nt, Artificial Sequence
  Marburg virus siRNA sense strand
cuuugcuugaaucaagaagau

SEQ ID NO: 37502 - RNA, 21 nt, Artificial Sequence
  Marburg virus siRNA sense strand
uuugcuugaaucaagaagauu

SEQ ID NO: 37503 - RNA, 21 nt, Artificial Sequence
  Marburg virus siRNA sense strand
uugcuugaaucaagaagauua

SEQ ID NO: 37504 - RNA, 21 nt, Artificial Sequence
  Marburg virus siRNA sense strand
ugcuugaaucaagaagauuaa

SEQ ID NO: 37505 - RNA, 21 nt, Artificial Sequence
  Marburg virus siRNA sense strand
gcuugaaucaagaagauuaau

SEQ ID NO: 37506 - RNA, 21 nt, Artificial Sequence
  Marburg virus siRNA sense strand
cuugaaucaagaagauuaaua

SEQ ID NO: 37507 - RNA, 21 nt, Artificial Sequence
  Marburg virus siRNA sense strand
uugaaucaagaagauuaauau

SEQ ID NO: 37508 - RNA, 21 nt, Artificial Sequence
  Marburg virus siRNA sense strand
ugaaucaagaagauuaauauu

SEQ ID NO: 37509 - RNA, 21 nt, Artificial Sequence
  Marburg virus siRNA sense strand
gaaucaagaagauuaauauug

SEQ ID NO: 37510 - RNA, 21 nt, Artificial Sequence
  Marburg virus siRNA sense strand
aaucaagaagauuaauauuga

SEQ ID NO: 37511 - RNA, 21 nt, Artificial Sequence
  Marburg virus siRNA sense strand
aucaagaagauuaauauugaa

SEQ ID NO: 37512 - RNA, 21 nt, Artificial Sequence
  Marburg virus siRNA sense strand
ucaagaagauuaauauugaac

SEQ ID NO: 37513 - RNA, 21 nt, Artificial Sequence
  Marburg virus siRNA sense strand
caagaagauuaauauugaaca

SEQ ID NO: 37514 - RNA, 21 nt, Artificial Sequence
  Marburg virus siRNA sense strand
aagaagauuaauauugaacaa

SEQ ID NO: 37515 - RNA, 21 nt, Artificial Sequence
  Marburg virus siRNA sense strand
agaagauuaauauugaacaac

SEQ ID NO: 37516 - RNA, 21 nt, Artificial Sequence
  Marburg virus siRNA sense strand
gaagauuaauauugaacaacc

SEQ ID NO: 37517 - RNA, 21 nt, Artificial Sequence
  Marburg virus siRNA sense strand
aagauuaauauugaacaaccu

SEQ ID NO: 37518 - RNA, 21 nt, Artificial Sequence
  Marburg virus siRNA sense strand
agauuaauauugaacaaccua

SEQ ID NO: 37519 - RNA, 21 nt, Artificial Sequence
  Marburg virus siRNA sense strand
gauuaauauugaacaaccuaa

SEQ ID NO: 37520 - RNA, 21 nt, Artificial Sequence
  Marburg virus siRNA sense strand
auuaauauugaacaaccuaac

SEQ ID NO: 37521 - RNA, 21 nt, Artificial Sequence
  Marburg virus siRNA sense strand
uuaauauugaacaaccuaacu

SEQ ID NO: 37522 - RNA, 21 nt, Artificial Sequence
  Marburg virus siRNA sense strand
uaauauugaacaaccuaacua

SEQ ID NO: 37523 - RNA, 21 nt, Artificial Sequence
  Marburg virus siRNA sense strand
aauauugaacaaccuaacuau

SEQ ID NO: 37524 - RNA, 21 nt, Artificial Sequence
  Marburg virus siRNA sense strand
auauugaacaaccuaacuauc

SEQ ID NO: 37525 - RNA, 21 nt, Artificial Sequence
  Marburg virus siRNA sense strand
uauugaacaaccuaacuaucc

SEQ ID NO: 37526 - RNA, 21 nt, Artificial Sequence
  Marburg virus siRNA sense strand
auugaacaaccuaacuaucca

SEQ ID NO: 37527 - RNA, 21 nt, Artificial Sequence
  Marburg virus siRNA sense strand
uugaacaaccuaacuauccaa

SEQ ID NO: 37528 - RNA, 21 nt, Artificial Sequence
  Marburg virus siRNA sense strand
ugaacaaccuaacuauccaaa

SEQ ID NO: 37529 - RNA, 21 nt, Artificial Sequence
  Marburg virus siRNA sense strand
gaacaaccuaacuauccaaau

SEQ ID NO: 37530 - RNA, 21 nt, Artificial Sequence
  Marburg virus siRNA sense strand
aacaaccuaacuauccaaauu

SEQ ID NO: 37531 - RNA, 21 nt, Artificial Sequence
  Marburg virus siRNA sense strand
acaaccuaacuauccaaauua

SEQ ID NO: 37532 - RNA, 21 nt, Artificial Sequence
  Marburg virus siRNA sense strand
caaccuaacuauccaaauuac

SEQ ID NO: 37533 - RNA, 21 nt, Artificial Sequence
  Marburg virus siRNA sense strand
aaccuaacuauccaaauuaca

SEQ ID NO: 37534 - RNA, 21 nt, Artificial Sequence
  Marburg virus siRNA sense strand
accuaacuauccaaauuacag

SEQ ID NO: 37535 - RNA, 21 nt, Artificial Sequence
  Marburg virus siRNA sense strand
ccuaacuauccaaauuacaga

SEQ ID NO: 37536 - RNA, 21 nt, Artificial Sequence
  Marburg virus siRNA sense strand
cuaacuauccaaauuacagau

SEQ ID NO: 37537 - RNA, 21 nt, Artificial Sequence
  Marburg virus siRNA sense strand
uaacuauccaaauuacagaua

SEQ ID NO: 37538 - RNA, 21 nt, Artificial Sequence
  Marburg virus siRNA sense strand
aacuauccaaauuacagauau

SEQ ID NO: 37539 - RNA, 21 nt, Artificial Sequence
  Marburg virus siRNA sense strand
acuauccaaauuacagauauu

SEQ ID NO: 37540 - RNA, 21 nt, Artificial Sequence
  Marburg virus siRNA sense strand
cuauccaaauuacagauauua

SEQ ID NO: 37541 - RNA, 21 nt, Artificial Sequence
  Marburg virus siRNA sense strand
uauccaaauuacagauauuac

SEQ ID NO: 37542 - RNA, 21 nt, Artificial Sequence
  Marburg virus siRNA sense strand
auccaaauuacagauauuaca

SEQ ID NO: 37543 - RNA, 21 nt, Artificial Sequence
  Marburg virus siRNA sense strand
uccaaauuacagauauuacaa

SEQ ID NO: 37544 - RNA, 21 nt, Artificial Sequence
  Marburg virus siRNA sense strand
ccaaauuacagauauuacaag

SEQ ID NO: 37545 - RNA, 21 nt, Artificial Sequence
  Marburg virus siRNA sense strand
caaauuacagauauuacaagu

SEQ ID NO: 37546 - RNA, 21 nt, Artificial Sequence
  Marburg virus siRNA sense strand
aaauuacagauauuacaaguc

SEQ ID NO: 37547 - RNA, 21 nt, Artificial Sequence
  Marburg virus siRNA sense strand
aauuacagauauuacaagucc

SEQ ID NO: 37548 - RNA, 21 nt, Artificial Sequence
  Marburg virus siRNA sense strand
auuacagauauuacaagucca

SEQ ID NO: 37549 - RNA, 21 nt, Artificial Sequence
  Marburg virus siRNA sense strand
uuacagauauuacaaguccac

SEQ ID NO: 37550 - RNA, 21 nt, Artificial Sequence
  Marburg virus siRNA sense strand
uacagauauuacaaguccacu

SEQ ID NO: 37551 - RNA, 21 nt, Artificial Sequence
  Marburg virus siRNA sense strand
acagauauuacaaguccacua

SEQ ID NO: 37552 - RNA, 21 nt, Artificial Sequence
  Marburg virus siRNA sense strand
cagauauuacaaguccacuau

SEQ ID NO: 37553 - RNA, 21 nt, Artificial Sequence
  Marburg virus siRNA sense strand
agauauuacaaguccacuaug

SEQ ID NO: 37554 - RNA, 21 nt, Artificial Sequence
  Marburg virus siRNA sense strand
gauauuacaaguccacuaugg

SEQ ID NO: 37555 - RNA, 21 nt, Artificial Sequence
  Marburg virus siRNA sense strand
auauuacaaguccacuauggc

SEQ ID NO: 37556 - RNA, 21 nt, Artificial Sequence
  Marburg virus siRNA sense strand
uauuacaaguccacuauggcu

SEQ ID NO: 37557 - RNA, 21 nt, Artificial Sequence
  Marburg virus siRNA sense strand
auuacaaguccacuauggcua

SEQ ID NO: 37558 - RNA, 21 nt, Artificial Sequence
  Marburg virus siRNA sense strand
uuacaaguccacuauggcuag

SEQ ID NO: 37559 - RNA, 21 nt, Artificial Sequence
  Marburg virus siRNA sense strand
uacaaguccacuauggcuaga

SEQ ID NO: 37560 - RNA, 21 nt, Artificial Sequence
  Marburg virus siRNA sense strand
acaaguccacuauggcuagau

SEQ ID NO: 37561 - RNA, 21 nt, Artificial Sequence
  Marburg virus siRNA sense strand
caaguccacuauggcuagauu

SEQ ID NO: 37562 - RNA, 21 nt, Artificial Sequence
  Marburg virus siRNA sense strand
aaguccacuauggcuagauuc

SEQ ID NO: 37563 - RNA, 21 nt, Artificial Sequence
  Marburg virus siRNA sense strand
aguccacuauggcuagauucu

SEQ ID NO: 37564 - RNA, 21 nt, Artificial Sequence
  Marburg virus siRNA sense strand
guccacuauggcuagauucug

SEQ ID NO: 37565 - RNA, 21 nt, Artificial Sequence
  Marburg virus siRNA sense strand
uccacuauggcuagauucugu

SEQ ID NO: 37566 - RNA, 21 nt, Artificial Sequence
  Marburg virus siRNA sense strand
ccacuauggcuagauucugua

SEQ ID NO: 37567 - RNA, 21 nt, Artificial Sequence
  Marburg virus siRNA sense strand
cacuauggcuagauucuguaa

SEQ ID NO: 37568 - RNA, 21 nt, Artificial Sequence
  Marburg virus siRNA sense strand
acuauggcuagauucuguaau

SEQ ID NO: 37569 - RNA, 21 nt, Artificial Sequence
  Marburg virus siRNA sense strand
cuauggcuagauucuguaaua

SEQ ID NO: 37570 - RNA, 21 nt, Artificial Sequence
  Marburg virus siRNA sense strand
uauggcuagauucuguaauac

SEQ ID NO: 37571 - RNA, 21 nt, Artificial Sequence
  Marburg virus siRNA sense strand
auggcuagauucuguaauaca

SEQ ID NO: 37572 - RNA, 21 nt, Artificial Sequence
  Marburg virus siRNA sense strand
uggcuagauucuguaauacaa

SEQ ID NO: 37573 - RNA, 21 nt, Artificial Sequence
  Marburg virus siRNA sense strand
ggcuagauucuguaauacaau

SEQ ID NO: 37574 - RNA, 21 nt, Artificial Sequence
  Marburg virus siRNA sense strand
gcuagauucuguaauacaaua

SEQ ID NO: 37575 - RNA, 21 nt, Artificial Sequence
  Marburg virus siRNA sense strand
cuagauucuguaauacaauac

SEQ ID NO: 37576 - RNA, 21 nt, Artificial Sequence
  Marburg virus siRNA sense strand
uagauucuguaauacaauacu

SEQ ID NO: 37577 - RNA, 21 nt, Artificial Sequence
  Marburg virus siRNA sense strand
agauucuguaauacaauacuu

SEQ ID NO: 37578 - RNA, 21 nt, Artificial Sequence
  Marburg virus siRNA sense strand
gauucuguaauacaauacuua

SEQ ID NO: 37579 - RNA, 21 nt, Artificial Sequence
  Marburg virus siRNA sense strand
auucuguaauacaauacuuac

SEQ ID NO: 37580 - RNA, 21 nt, Artificial Sequence
  Marburg virus siRNA sense strand
uucuguaauacaauacuuacc

SEQ ID NO: 37581 - RNA, 21 nt, Artificial Sequence
  Marburg virus siRNA sense strand
ucuguaauacaauacuuaccu

SEQ ID NO: 37582 - RNA, 21 nt, Artificial Sequence
  Marburg virus siRNA sense strand
cuguaauacaauacuuaccug

SEQ ID NO: 37583 - RNA, 21 nt, Artificial Sequence
  Marburg virus siRNA sense strand
uguaauacaauacuuaccuga

SEQ ID NO: 37584 - RNA, 21 nt, Artificial Sequence
  Marburg virus siRNA sense strand
guaauacaauacuuaccugaa

SEQ ID NO: 37585 - RNA, 21 nt, Artificial Sequence
  Marburg virus siRNA sense strand
uaauacaauacuuaccugaag

SEQ ID NO: 37586 - RNA, 21 nt, Artificial Sequence
  Marburg virus siRNA sense strand
aauacaauacuuaccugaaga

SEQ ID NO: 37587 - RNA, 21 nt, Artificial Sequence
  Marburg virus siRNA sense strand
auacaauacuuaccugaagau

SEQ ID NO: 37588 - RNA, 21 nt, Artificial Sequence
  Marburg virus siRNA sense strand
uacaauacuuaccugaagaua

SEQ ID NO: 37589 - RNA, 21 nt, Artificial Sequence
  Marburg virus siRNA sense strand
acaauacuuaccugaagauag

SEQ ID NO: 37590 - RNA, 21 nt, Artificial Sequence
  Marburg virus siRNA sense strand
caauacuuaccugaagauagc

SEQ ID NO: 37591 - RNA, 21 nt, Artificial Sequence
  Marburg virus siRNA sense strand
aauacuuaccugaagauagcg

SEQ ID NO: 37592 - RNA, 21 nt, Artificial Sequence
  Marburg virus siRNA sense strand
auacuuaccugaagauagcga

SEQ ID NO: 37593 - RNA, 21 nt, Artificial Sequence
  Marburg virus siRNA sense strand
uacuuaccugaagauagcgac

SEQ ID NO: 37594 - RNA, 21 nt, Artificial Sequence
  Marburg virus siRNA sense strand
acuuaccugaagauagcgaca

SEQ ID NO: 37595 - RNA, 21 nt, Artificial Sequence
  Marburg virus siRNA sense strand
cuuaccugaagauagcgacau

SEQ ID NO: 37596 - RNA, 21 nt, Artificial Sequence
  Marburg virus siRNA sense strand
uuaccugaagauagcgacauu

SEQ ID NO: 37597 - RNA, 21 nt, Artificial Sequence
  Marburg virus siRNA sense strand
uaccugaagauagcgacauuc

SEQ ID NO: 37598 - RNA, 21 nt, Artificial Sequence
  Marburg virus siRNA sense strand
accugaagauagcgacauucu

SEQ ID NO: 37599 - RNA, 21 nt, Artificial Sequence
  Marburg virus siRNA sense strand
ccugaagauagcgacauucuu

SEQ ID NO: 37600 - RNA, 21 nt, Artificial Sequence
  Marburg virus siRNA sense strand
cugaagauagcgacauucuua

SEQ ID NO: 37601 - RNA, 21 nt, Artificial Sequence
  Marburg virus siRNA sense strand
ugaagauagcgacauucuuac

SEQ ID NO: 37602 - RNA, 21 nt, Artificial Sequence
  Marburg virus siRNA sense strand
gaagauagcgacauucuuaca

SEQ ID NO: 37603 - RNA, 21 nt, Artificial Sequence
  Marburg virus siRNA sense strand
aagauagcgacauucuuacaa

SEQ ID NO: 37604 - RNA, 21 nt, Artificial Sequence
  Marburg virus siRNA sense strand
agauagcgacauucuuacaau

SEQ ID NO: 37605 - RNA, 21 nt, Artificial Sequence
  Marburg virus siRNA sense strand
gauagcgacauucuuacaaug

SEQ ID NO: 37606 - RNA, 21 nt, Artificial Sequence
  Marburg virus siRNA sense strand
auagcgacauucuuacaaugg

SEQ ID NO: 37607 - RNA, 21 nt, Artificial Sequence
  Marburg virus siRNA sense strand
uagcgacauucuuacaaugga

SEQ ID NO: 37608 - RNA, 21 nt, Artificial Sequence
  Marburg virus siRNA sense strand
agcgacauucuuacaauggac

SEQ ID NO: 37609 - RNA, 21 nt, Artificial Sequence
  Marburg virus siRNA sense strand
gcgacauucuuacaauggacg

SEQ ID NO: 37610 - RNA, 21 nt, Artificial Sequence
  Marburg virus siRNA sense strand
cgacauucuuacaauggacgc

SEQ ID NO: 37611 - RNA, 21 nt, Artificial Sequence
  Marburg virus siRNA sense strand
gacauucuuacaauggacgca

SEQ ID NO: 37612 - RNA, 21 nt, Artificial Sequence
  Marburg virus siRNA sense strand
acauucuuacaauggacgcag

SEQ ID NO: 37613 - RNA, 21 nt, Artificial Sequence
  Marburg virus siRNA sense strand
cauucuuacaauggacgcaga

SEQ ID NO: 37614 - RNA, 21 nt, Artificial Sequence
  Marburg virus siRNA sense strand
auucuuacaauggacgcagag

SEQ ID NO: 37615 - RNA, 21 nt, Artificial Sequence
  Marburg virus siRNA sense strand
uucuuacaauggacgcagaga

SEQ ID NO: 37616 - RNA, 21 nt, Artificial Sequence
  Marburg virus siRNA sense strand
ucuuacaauggacgcagagac

SEQ ID NO: 37617 - RNA, 21 nt, Artificial Sequence
  Marburg virus siRNA sense strand
cuuacaauggacgcagagacc

SEQ ID NO: 37618 - RNA, 21 nt, Artificial Sequence
  Marburg virus siRNA sense strand
uuacaauggacgcagagacca

SEQ ID NO: 37619 - RNA, 21 nt, Artificial Sequence
  Marburg virus siRNA sense strand
uacaauggacgcagagaccac

SEQ ID NO: 37620 - RNA, 21 nt, Artificial Sequence
  Marburg virus siRNA sense strand
acaauggacgcagagaccacu

SEQ ID NO: 37621 - RNA, 21 nt, Artificial Sequence
  Marburg virus siRNA sense strand
caauggacgcagagaccacua

SEQ ID NO: 37622 - RNA, 21 nt, Artificial Sequence
  Marburg virus siRNA sense strand
aauggacgcagagaccacuaa

SEQ ID NO: 37623 - RNA, 21 nt, Artificial Sequence
  Marburg virus siRNA sense strand
auggacgcagagaccacuaaa

SEQ ID NO: 37624 - RNA, 21 nt, Artificial Sequence
  Marburg virus siRNA sense strand
uggacgcagagaccacuaaag

SEQ ID NO: 37625 - RNA, 21 nt, Artificial Sequence
  Marburg virus siRNA sense strand
ggacgcagagaccacuaaaga

SEQ ID NO: 37626 - RNA, 21 nt, Artificial Sequence
  Marburg virus siRNA sense strand
gacgcagagaccacuaaagau

SEQ ID NO: 37627 - RNA, 21 nt, Artificial Sequence
  Marburg virus siRNA sense strand
acgcagagaccacuaaagaug

SEQ ID NO: 37628 - RNA, 21 nt, Artificial Sequence
  Marburg virus siRNA sense strand
cgcagagaccacuaaagauga

SEQ ID NO: 37629 - RNA, 21 nt, Artificial Sequence
  Marburg virus siRNA sense strand
gcagagaccacuaaagaugaa

SEQ ID NO: 37630 - RNA, 21 nt, Artificial Sequence
  Marburg virus siRNA sense strand
cagagaccacuaaagaugaaa

SEQ ID NO: 37631 - RNA, 21 nt, Artificial Sequence
  Marburg virus siRNA sense strand
agagaccacuaaagaugaaac

SEQ ID NO: 37632 - RNA, 21 nt, Artificial Sequence
  Marburg virus siRNA sense strand
gagaccacuaaagaugaaaca

SEQ ID NO: 37633 - RNA, 21 nt, Artificial Sequence
  Marburg virus siRNA sense strand
agaccacuaaagaugaaacaa

SEQ ID NO: 37634 - RNA, 21 nt, Artificial Sequence
  Marburg virus siRNA sense strand
gaccacuaaagaugaaacaag

SEQ ID NO: 37635 - RNA, 21 nt, Artificial Sequence
  Marburg virus siRNA sense strand
accacuaaagaugaaacaagg

SEQ ID NO: 37636 - RNA, 21 nt, Artificial Sequence
  Marburg virus siRNA sense strand
ccacuaaagaugaaacaaggg

SEQ ID NO: 37637 - RNA, 21 nt, Artificial Sequence
  Marburg virus siRNA sense strand
cacuaaagaugaaacaaggga

SEQ ID NO: 37638 - RNA, 21 nt, Artificial Sequence
  Marburg virus siRNA sense strand
acuaaagaugaaacaagggaa

SEQ ID NO: 37639 - RNA, 21 nt, Artificial Sequence
  Marburg virus siRNA sense strand
cuaaagaugaaacaagggaac

SEQ ID NO: 37640 - RNA, 21 nt, Artificial Sequence
  Marburg virus siRNA sense strand
uaaagaugaaacaagggaaca

SEQ ID NO: 37641 - RNA, 21 nt, Artificial Sequence
  Marburg virus siRNA sense strand
aaagaugaaacaagggaacag

SEQ ID NO: 37642 - RNA, 21 nt, Artificial Sequence
  Marburg virus siRNA sense strand
aagaugaaacaagggaacagc

SEQ ID NO: 37643 - RNA, 21 nt, Artificial Sequence
  Marburg virus siRNA sense strand
agaugaaacaagggaacagcu

SEQ ID NO: 37644 - RNA, 21 nt, Artificial Sequence
  Marburg virus siRNA sense strand
gaugaaacaagggaacagcuu

SEQ ID NO: 37645 - RNA, 21 nt, Artificial Sequence
  Marburg virus siRNA sense strand
augaaacaagggaacagcuuu

SEQ ID NO: 37646 - RNA, 21 nt, Artificial Sequence
  Marburg virus siRNA sense strand
ugaaacaagggaacagcuuua

SEQ ID NO: 37647 - RNA, 21 nt, Artificial Sequence
  Marburg virus siRNA sense strand
gaaacaagggaacagcuuuau

SEQ ID NO: 37648 - RNA, 21 nt, Artificial Sequence
  Marburg virus siRNA sense strand
aaacaagggaacagcuuuaua

SEQ ID NO: 37649 - RNA, 21 nt, Artificial Sequence
  Marburg virus siRNA sense strand
aacaagggaacagcuuuauaa

SEQ ID NO: 37650 - RNA, 21 nt, Artificial Sequence
  Marburg virus siRNA sense strand
acaagggaacagcuuuauaag

SEQ ID NO: 37651 - RNA, 21 nt, Artificial Sequence
  Marburg virus siRNA sense strand
caagggaacagcuuuauaaga

SEQ ID NO: 37652 - RNA, 21 nt, Artificial Sequence
  Marburg virus siRNA sense strand
aagggaacagcuuuauaagac

SEQ ID NO: 37653 - RNA, 21 nt, Artificial Sequence
  Marburg virus siRNA sense strand
agggaacagcuuuauaagacu

SEQ ID NO: 37654 - RNA, 21 nt, Artificial Sequence
  Marburg virus siRNA sense strand
gggaacagcuuuauaagacua

SEQ ID NO: 37655 - RNA, 21 nt, Artificial Sequence
  Marburg virus siRNA sense strand
ggaacagcuuuauaagacuau

SEQ ID NO: 37656 - RNA, 21 nt, Artificial Sequence
  Marburg virus siRNA sense strand
gaacagcuuuauaagacuauu

SEQ ID NO: 37657 - RNA, 21 nt, Artificial Sequence
  Marburg virus siRNA sense strand
aacagcuuuauaagacuauug

SEQ ID NO: 37658 - RNA, 21 nt, Artificial Sequence
  Marburg virus siRNA sense strand
acagcuuuauaagacuauugu

SEQ ID NO: 37659 - RNA, 21 nt, Artificial Sequence
  Marburg virus siRNA sense strand
cagcuuuauaagacuauugug

SEQ ID NO: 37660 - RNA, 21 nt, Artificial Sequence
  Marburg virus siRNA sense strand
agcuuuauaagacuauuguga

SEQ ID NO: 37661 - RNA, 21 nt, Artificial Sequence
  Marburg virus siRNA sense strand
gcuuuauaagacuauugugaa

SEQ ID NO: 37662 - RNA, 21 nt, Artificial Sequence
  Marburg virus siRNA sense strand
cuuuauaagacuauugugaau

SEQ ID NO: 37663 - RNA, 21 nt, Artificial Sequence
  Marburg virus siRNA sense strand
uuuauaagacuauugugaaua

SEQ ID NO: 37664 - RNA, 21 nt, Artificial Sequence
  Marburg virus siRNA sense strand
uuauaagacuauugugaauau

SEQ ID NO: 37665 - RNA, 21 nt, Artificial Sequence
  Marburg virus siRNA sense strand
uauaagacuauugugaauauu

SEQ ID NO: 37666 - RNA, 21 nt, Artificial Sequence
  Marburg virus siRNA sense strand
auaagacuauugugaauauuu

SEQ ID NO: 37667 - RNA, 21 nt, Artificial Sequence
  Marburg virus siRNA sense strand
uaagacuauugugaauauuug

SEQ ID NO: 37668 - RNA, 21 nt, Artificial Sequence
  Marburg virus siRNA sense strand
aagacuauugugaauauuugg

SEQ ID NO: 37669 - RNA, 21 nt, Artificial Sequence
  Marburg virus siRNA sense strand
agacuauugugaauauuugga

SEQ ID NO: 37670 - RNA, 21 nt, Artificial Sequence
  Marburg virus siRNA sense strand
gacuauugugaauauuuggac

SEQ ID NO: 37671 - RNA, 21 nt, Artificial Sequence
  Marburg virus siRNA sense strand
acuauugugaauauuuggaca

SEQ ID NO: 37672 - RNA, 21 nt, Artificial Sequence
  Marburg virus siRNA sense strand
cuauugugaauauuuggacac

SEQ ID NO: 37673 - RNA, 21 nt, Artificial Sequence
  Marburg virus siRNA sense strand
uauugugaauauuuggacacg

SEQ ID NO: 37674 - RNA, 21 nt, Artificial Sequence
  Marburg virus siRNA sense strand
auugugaauauuuggacacgu

SEQ ID NO: 37675 - RNA, 21 nt, Artificial Sequence
  Marburg virus siRNA sense strand
uugugaauauuuggacacgua

SEQ ID NO: 37676 - RNA, 21 nt, Artificial Sequence
  Marburg virus siRNA sense strand
ugugaauauuuggacacguac

SEQ ID NO: 37677 - RNA, 21 nt, Artificial Sequence
  Marburg virus siRNA sense strand
gugaauauuuggacacguacu

SEQ ID NO: 37678 - RNA, 21 nt, Artificial Sequence
  Marburg virus siRNA sense strand
ugaauauuuggacacguacuu

SEQ ID NO: 37679 - RNA, 21 nt, Artificial Sequence
  Marburg virus siRNA sense strand
gaauauuuggacacguacuuc

SEQ ID NO: 37680 - RNA, 21 nt, Artificial Sequence
  Marburg virus siRNA sense strand
aauauuuggacacguacuucu

SEQ ID NO: 37681 - RNA, 21 nt, Artificial Sequence
  Marburg virus siRNA sense strand
auauuuggacacguacuucuc

SEQ ID NO: 37682 - RNA, 21 nt, Artificial Sequence
  Marburg virus siRNA sense strand
uauuuggacacguacuucucc

SEQ ID NO: 37683 - RNA, 21 nt, Artificial Sequence
  Marburg virus siRNA sense strand
auuuggacacguacuucuccu

SEQ ID NO: 37684 - RNA, 21 nt, Artificial Sequence
  Marburg virus siRNA sense strand
uuuggacacguacuucuccua

SEQ ID NO: 37685 - RNA, 21 nt, Artificial Sequence
  Marburg virus siRNA sense strand
uuggacacguacuucuccuaa

SEQ ID NO: 37686 - RNA, 21 nt, Artificial Sequence
  Marburg virus siRNA sense strand
uggacacguacuucuccuaau

SEQ ID NO: 37687 - RNA, 21 nt, Artificial Sequence
  Marburg virus siRNA sense strand
ggacacguacuucuccuaaua

SEQ ID NO: 37688 - RNA, 21 nt, Artificial Sequence
  Marburg virus siRNA sense strand
gacacguacuucuccuaauau

SEQ ID NO: 37689 - RNA, 21 nt, Artificial Sequence
  Marburg virus siRNA sense strand
acacguacuucuccuaauauu

SEQ ID NO: 37690 - RNA, 21 nt, Artificial Sequence
  Marburg virus siRNA sense strand
cacguacuucuccuaauauuc

SEQ ID NO: 37691 - RNA, 21 nt, Artificial Sequence
  Marburg virus siRNA sense strand
acguacuucuccuaauauucc

SEQ ID NO: 37692 - RNA, 21 nt, Artificial Sequence
  Marburg virus siRNA sense strand
cguacuucuccuaauauucca

SEQ ID NO: 37693 - RNA, 21 nt, Artificial Sequence
  Marburg virus siRNA sense strand
guacuucuccuaauauuccaa

SEQ ID NO: 37694 - RNA, 21 nt, Artificial Sequence
  Marburg virus siRNA sense strand
uacuucuccuaauauuccaaa

SEQ ID NO: 37695 - RNA, 21 nt, Artificial Sequence
  Marburg virus siRNA sense strand
acuucuccuaauauuccaaaa

SEQ ID NO: 37696 - RNA, 21 nt, Artificial Sequence
  Marburg virus siRNA sense strand
cuucuccuaauauuccaaaaa

SEQ ID NO: 37697 - RNA, 21 nt, Artificial Sequence
  Marburg virus siRNA sense strand
uucuccuaauauuccaaaaau

SEQ ID NO: 37698 - RNA, 21 nt, Artificial Sequence
  Marburg virus siRNA sense strand
ucuccuaauauuccaaaaauu

SEQ ID NO: 37699 - RNA, 21 nt, Artificial Sequence
  Marburg virus siRNA sense strand
cuccuaauauuccaaaaauua

SEQ ID NO: 37700 - RNA, 21 nt, Artificial Sequence
  Marburg virus siRNA sense strand
uccuaauauuccaaaaauuag

SEQ ID NO: 37701 - RNA, 21 nt, Artificial Sequence
  Marburg virus siRNA sense strand
ccuaauauuccaaaaauuagc

SEQ ID NO: 37702 - RNA, 21 nt, Artificial Sequence
  Marburg virus siRNA sense strand
cuaauauuccaaaaauuagca

SEQ ID NO: 37703 - RNA, 21 nt, Artificial Sequence
  Marburg virus siRNA sense strand
uaauauuccaaaaauuagcau

SEQ ID NO: 37704 - RNA, 21 nt, Artificial Sequence
  Marburg virus siRNA sense strand
aauauuccaaaaauuagcauc

SEQ ID NO: 37705 - RNA, 21 nt, Artificial Sequence
  Marburg virus siRNA sense strand
auauuccaaaaauuagcauca

SEQ ID NO: 37706 - RNA, 21 nt, Artificial Sequence
  Marburg virus siRNA sense strand
uauuccaaaaauuagcaucau

SEQ ID NO: 37707 - RNA, 21 nt, Artificial Sequence
  Marburg virus siRNA sense strand
auuccaaaaauuagcaucauc

SEQ ID NO: 37708 - RNA, 21 nt, Artificial Sequence
  Marburg virus siRNA sense strand
uuccaaaaauuagcaucauca

SEQ ID NO: 37709 - RNA, 21 nt, Artificial Sequence
  Marburg virus siRNA sense strand
uccaaaaauuagcaucaucaa

SEQ ID NO: 37710 - RNA, 21 nt, Artificial Sequence
  Marburg virus siRNA sense strand
ccaaaaauuagcaucaucaag

SEQ ID NO: 37711 - RNA, 21 nt, Artificial Sequence
  Marburg virus siRNA sense strand
caaaaauuagcaucaucaagg

SEQ ID NO: 37712 - RNA, 21 nt, Artificial Sequence
  Marburg virus siRNA sense strand
aaaaauuagcaucaucaaggu

SEQ ID NO: 37713 - RNA, 21 nt, Artificial Sequence
  Marburg virus siRNA sense strand
aaaauuagcaucaucaaggua

SEQ ID NO: 37714 - RNA, 21 nt, Artificial Sequence
  Marburg virus siRNA sense strand
aaauuagcaucaucaagguau

SEQ ID NO: 37715 - RNA, 21 nt, Artificial Sequence
  Marburg virus siRNA sense strand
aauuagcaucaucaagguauu

SEQ ID NO: 37716 - RNA, 21 nt, Artificial Sequence
  Marburg virus siRNA sense strand
auuagcaucaucaagguauuu

SEQ ID NO: 37717 - RNA, 21 nt, Artificial Sequence
  Marburg virus siRNA sense strand
uuagcaucaucaagguauuuu

SEQ ID NO: 37718 - RNA, 21 nt, Artificial Sequence
  Marburg virus siRNA sense strand
uagcaucaucaagguauuuuu

SEQ ID NO: 37719 - RNA, 21 nt, Artificial Sequence
  Marburg virus siRNA sense strand
agcaucaucaagguauuuuua

SEQ ID NO: 37720 - RNA, 21 nt, Artificial Sequence
  Marburg virus siRNA sense strand
gcaucaucaagguauuuuuau

SEQ ID NO: 37721 - RNA, 21 nt, Artificial Sequence
  Marburg virus siRNA sense strand
caucaucaagguauuuuuauu

SEQ ID NO: 37722 - RNA, 21 nt, Artificial Sequence
  Marburg virus siRNA sense strand
aucaucaagguauuuuuauua

SEQ ID NO: 37723 - RNA, 21 nt, Artificial Sequence
  Marburg virus siRNA sense strand
ucaucaagguauuuuuauuag

SEQ ID NO: 37724 - RNA, 21 nt, Artificial Sequence
  Marburg virus siRNA sense strand
caucaagguauuuuuauuaga

SEQ ID NO: 37725 - RNA, 21 nt, Artificial Sequence
  Marburg virus siRNA sense strand
aucaagguauuuuuauuagac

SEQ ID NO: 37726 - RNA, 21 nt, Artificial Sequence
  Marburg virus siRNA sense strand
ucaagguauuuuuauuagacu

SEQ ID NO: 37727 - RNA, 21 nt, Artificial Sequence
  Marburg virus siRNA sense strand
caagguauuuuuauuagacua

SEQ ID NO: 37728 - RNA, 21 nt, Artificial Sequence
  Marburg virus siRNA sense strand
aagguauuuuuauuagacuau

SEQ ID NO: 37729 - RNA, 21 nt, Artificial Sequence
  Marburg virus siRNA sense strand
agguauuuuuauuagacuaug

SEQ ID NO: 37730 - RNA, 21 nt, Artificial Sequence
  Marburg virus siRNA sense strand
gguauuuuuauuagacuauga

SEQ ID NO: 37731 - RNA, 21 nt, Artificial Sequence
  Marburg virus siRNA sense strand
guauuuuuauuagacuaugaa

SEQ ID NO: 37732 - RNA, 21 nt, Artificial Sequence
  Marburg virus siRNA sense strand
uauuuuuauuagacuaugaag

SEQ ID NO: 37733 - RNA, 21 nt, Artificial Sequence
  Marburg virus siRNA sense strand
auuuuuauuagacuaugaagg

SEQ ID NO: 37734 - RNA, 21 nt, Artificial Sequence
  Marburg virus siRNA sense strand
uuuuuauuagacuaugaaggg

SEQ ID NO: 37735 - RNA, 21 nt, Artificial Sequence
  Marburg virus siRNA sense strand
uuuuauuagacuaugaaggga

SEQ ID NO: 37736 - RNA, 21 nt, Artificial Sequence
  Marburg virus siRNA sense strand
uuuauuagacuaugaagggac

SEQ ID NO: 37737 - RNA, 21 nt, Artificial Sequence
  Marburg virus siRNA sense strand
uuauuagacuaugaagggacu

SEQ ID NO: 37738 - RNA, 21 nt, Artificial Sequence
  Marburg virus siRNA sense strand
uauuagacuaugaagggacuu

SEQ ID NO: 37739 - RNA, 21 nt, Artificial Sequence
  Marburg virus siRNA sense strand
auuagacuaugaagggacuuu

SEQ ID NO: 37740 - RNA, 21 nt, Artificial Sequence
  Marburg virus siRNA sense strand
uuagacuaugaagggacuuug

SEQ ID NO: 37741 - RNA, 21 nt, Artificial Sequence
  Marburg virus siRNA sense strand
uagacuaugaagggacuuugu

SEQ ID NO: 37742 - RNA, 21 nt, Artificial Sequence
  Marburg virus siRNA sense strand
agacuaugaagggacuuuguu

SEQ ID NO: 37743 - RNA, 21 nt, Artificial Sequence
  Marburg virus siRNA sense strand
gacuaugaagggacuuuguuc

SEQ ID NO: 37744 - RNA, 21 nt, Artificial Sequence
  Marburg virus siRNA sense strand
acuaugaagggacuuuguucu

SEQ ID NO: 37745 - RNA, 21 nt, Artificial Sequence
  Marburg virus siRNA sense strand
cuaugaagggacuuuguucuu

SEQ ID NO: 37746 - RNA, 21 nt, Artificial Sequence
  Marburg virus siRNA sense strand
uaugaagggacuuuguucuua

SEQ ID NO: 37747 - RNA, 21 nt, Artificial Sequence
  Marburg virus siRNA sense strand
augaagggacuuuguucuuaa

SEQ ID NO: 37748 - RNA, 21 nt, Artificial Sequence
  Marburg virus siRNA sense strand
ugaagggacuuuguucuuaau

SEQ ID NO: 37749 - RNA, 21 nt, Artificial Sequence
  Marburg virus siRNA sense strand
gaagggacuuuguucuuaaug

SEQ ID NO: 37750 - RNA, 21 nt, Artificial Sequence
  Marburg virus siRNA sense strand
aagggacuuuguucuuaauga

SEQ ID NO: 37751 - RNA, 21 nt, Artificial Sequence
  Marburg virus siRNA sense strand
agggacuuuguucuuaaugag

SEQ ID NO: 37752 - RNA, 21 nt, Artificial Sequence
  Marburg virus siRNA sense strand
gggacuuuguucuuaaugagg

SEQ ID NO: 37753 - RNA, 21 nt, Artificial Sequence
  Marburg virus siRNA sense strand
ggacuuuguucuuaaugagga

SEQ ID NO: 37754 - RNA, 21 nt, Artificial Sequence
  Marburg virus siRNA sense strand
gacuuuguucuuaaugaggaa

SEQ ID NO: 37755 - RNA, 21 nt, Artificial Sequence
  Marburg virus siRNA sense strand
acuuuguucuuaaugaggaau

SEQ ID NO: 37756 - RNA, 21 nt, Artificial Sequence
  Marburg virus siRNA sense strand
cuuuguucuuaaugaggaaug

SEQ ID NO: 37757 - RNA, 21 nt, Artificial Sequence
  Marburg virus siRNA sense strand
uuuguucuuaaugaggaaugc

SEQ ID NO: 37758 - RNA, 21 nt, Artificial Sequence
  Marburg virus siRNA sense strand
uuguucuuaaugaggaaugcc

SEQ ID NO: 37759 - RNA, 21 nt, Artificial Sequence
  Marburg virus siRNA sense strand
uguucuuaaugaggaaugcca

SEQ ID NO: 37760 - RNA, 21 nt, Artificial Sequence
  Marburg virus siRNA sense strand
guucuuaaugaggaaugccau

SEQ ID NO: 37761 - RNA, 21 nt, Artificial Sequence
  Marburg virus siRNA sense strand
uucuuaaugaggaaugccauu

SEQ ID NO: 37762 - RNA, 21 nt, Artificial Sequence
  Marburg virus siRNA sense strand
ucuuaaugaggaaugccauuc

SEQ ID NO: 37763 - RNA, 21 nt, Artificial Sequence
  Marburg virus siRNA sense strand
cuuaaugaggaaugccauuca

SEQ ID NO: 37764 - RNA, 21 nt, Artificial Sequence
  Marburg virus siRNA sense strand
uuaaugaggaaugccauucag

SEQ ID NO: 37765 - RNA, 21 nt, Artificial Sequence
  Marburg virus siRNA sense strand
uaaugaggaaugccauucagu

SEQ ID NO: 37766 - RNA, 21 nt, Artificial Sequence
  Marburg virus siRNA sense strand
aaugaggaaugccauucagua

SEQ ID NO: 37767 - RNA, 21 nt, Artificial Sequence
  Marburg virus siRNA sense strand
augaggaaugccauucaguau

SEQ ID NO: 37768 - RNA, 21 nt, Artificial Sequence
  Marburg virus siRNA sense strand
ugaggaaugccauucaguauu

SEQ ID NO: 37769 - RNA, 21 nt, Artificial Sequence
  Marburg virus siRNA sense strand
gaggaaugccauucaguauua

SEQ ID NO: 37770 - RNA, 21 nt, Artificial Sequence
  Marburg virus siRNA sense strand
aggaaugccauucaguauuau

SEQ ID NO: 37771 - RNA, 21 nt, Artificial Sequence
  Marburg virus siRNA sense strand
ggaaugccauucaguauuaug

SEQ ID NO: 37772 - RNA, 21 nt, Artificial Sequence
  Marburg virus siRNA sense strand
gaaugccauucaguauuaugg

SEQ ID NO: 37773 - RNA, 21 nt, Artificial Sequence
  Marburg virus siRNA sense strand
aaugccauucaguauuauggg

SEQ ID NO: 37774 - RNA, 21 nt, Artificial Sequence
  Marburg virus siRNA sense strand
augccauucaguauuaugggc

SEQ ID NO: 37775 - RNA, 21 nt, Artificial Sequence
  Marburg virus siRNA sense strand
ugccauucaguauuaugggca

SEQ ID NO: 37776 - RNA, 21 nt, Artificial Sequence
  Marburg virus siRNA sense strand
gccauucaguauuaugggcag

SEQ ID NO: 37777 - RNA, 21 nt, Artificial Sequence
  Marburg virus siRNA sense strand
ccauucaguauuaugggcagg

SEQ ID NO: 37778 - RNA, 21 nt, Artificial Sequence
  Marburg virus siRNA sense strand
cauucaguauuaugggcaggu

SEQ ID NO: 37779 - RNA, 21 nt, Artificial Sequence
  Marburg virus siRNA sense strand
auucaguauuaugggcagguu

SEQ ID NO: 37780 - RNA, 21 nt, Artificial Sequence
  Marburg virus siRNA sense strand
uucaguauuaugggcagguuc

SEQ ID NO: 37781 - RNA, 21 nt, Artificial Sequence
  Marburg virus siRNA sense strand
ucaguauuaugggcagguuca

SEQ ID NO: 37782 - RNA, 21 nt, Artificial Sequence
  Marburg virus siRNA sense strand
caguauuaugggcagguucaa

SEQ ID NO: 37783 - RNA, 21 nt, Artificial Sequence
  Marburg virus siRNA sense strand
aguauuaugggcagguucaac

SEQ ID NO: 37784 - RNA, 21 nt, Artificial Sequence
  Marburg virus siRNA sense strand
guauuaugggcagguucaacu

SEQ ID NO: 37785 - RNA, 21 nt, Artificial Sequence
  Marburg virus siRNA sense strand
uauuaugggcagguucaacuc

SEQ ID NO: 37786 - RNA, 21 nt, Artificial Sequence
  Marburg virus siRNA sense strand
auuaugggcagguucaacuca

SEQ ID NO: 37787 - RNA, 21 nt, Artificial Sequence
  Marburg virus siRNA sense strand
uuaugggcagguucaacucaa

SEQ ID NO: 37788 - RNA, 21 nt, Artificial Sequence
  Marburg virus siRNA sense strand
uaugggcagguucaacucaag

SEQ ID NO: 37789 - RNA, 21 nt, Artificial Sequence
  Marburg virus siRNA sense strand
augggcagguucaacucaaga

SEQ ID NO: 37790 - RNA, 21 nt, Artificial Sequence
  Marburg virus siRNA sense strand
ugggcagguucaacucaagaa

SEQ ID NO: 37791 - RNA, 21 nt, Artificial Sequence
  Marburg virus siRNA sense strand
gggcagguucaacucaagaaa

SEQ ID NO: 37792 - RNA, 21 nt, Artificial Sequence
  Marburg virus siRNA sense strand
ggcagguucaacucaagaaac

SEQ ID NO: 37793 - RNA, 21 nt, Artificial Sequence
  Marburg virus siRNA sense strand
gcagguucaacucaagaaacc

SEQ ID NO: 37794 - RNA, 21 nt, Artificial Sequence
  Marburg virus siRNA sense strand
cagguucaacucaagaaacca

SEQ ID NO: 37795 - RNA, 21 nt, Artificial Sequence
  Marburg virus siRNA sense strand
agguucaacucaagaaaccau

SEQ ID NO: 37796 - RNA, 21 nt, Artificial Sequence
  Marburg virus siRNA sense strand
gguucaacucaagaaaccaua

SEQ ID NO: 37797 - RNA, 21 nt, Artificial Sequence
  Marburg virus siRNA sense strand
guucaacucaagaaaccauau

SEQ ID NO: 37798 - RNA, 21 nt, Artificial Sequence
  Marburg virus siRNA sense strand
uucaacucaagaaaccauaua

SEQ ID NO: 37799 - RNA, 21 nt, Artificial Sequence
  Marburg virus siRNA sense strand
ucaacucaagaaaccauauag

SEQ ID NO: 37800 - RNA, 21 nt, Artificial Sequence
  Marburg virus siRNA sense strand
caacucaagaaaccauauagc

SEQ ID NO: 37801 - RNA, 21 nt, Artificial Sequence
  Marburg virus siRNA sense strand
aacucaagaaaccauauagcu

SEQ ID NO: 37802 - RNA, 21 nt, Artificial Sequence
  Marburg virus siRNA sense strand
acucaagaaaccauauagcuc

SEQ ID NO: 37803 - RNA, 21 nt, Artificial Sequence
  Marburg virus siRNA sense strand
cucaagaaaccauauagcuca

SEQ ID NO: 37804 - RNA, 21 nt, Artificial Sequence
  Marburg virus siRNA sense strand
ucaagaaaccauauagcucaa

SEQ ID NO: 37805 - RNA, 21 nt, Artificial Sequence
  Marburg virus siRNA sense strand
caagaaaccauauagcucaaa

SEQ ID NO: 37806 - RNA, 21 nt, Artificial Sequence
  Marburg virus siRNA sense strand
aagaaaccauauagcucaaau

SEQ ID NO: 37807 - RNA, 21 nt, Artificial Sequence
  Marburg virus siRNA sense strand
agaaaccauauagcucaaaug

SEQ ID NO: 37808 - RNA, 21 nt, Artificial Sequence
  Marburg virus siRNA sense strand
gaaaccauauagcucaaaugc

SEQ ID NO: 37809 - RNA, 21 nt, Artificial Sequence
  Marburg virus siRNA sense strand
aaaccauauagcucaaaugca

SEQ ID NO: 37810 - RNA, 21 nt, Artificial Sequence
  Marburg virus siRNA sense strand
aaccauauagcucaaaugcaa

SEQ ID NO: 37811 - RNA, 21 nt, Artificial Sequence
  Marburg virus siRNA sense strand
accauauagcucaaaugcaaa

SEQ ID NO: 37812 - RNA, 21 nt, Artificial Sequence
  Marburg virus siRNA sense strand
ccauauagcucaaaugcaaaa

SEQ ID NO: 37813 - RNA, 21 nt, Artificial Sequence
  Marburg virus siRNA sense strand
cauauagcucaaaugcaaaaa

SEQ ID NO: 37814 - RNA, 21 nt, Artificial Sequence
  Marburg virus siRNA sense strand
auauagcucaaaugcaaaaaa

SEQ ID NO: 37815 - RNA, 21 nt, Artificial Sequence
  Marburg virus siRNA sense strand
uauagcucaaaugcaaaaaac

SEQ ID NO: 37816 - RNA, 21 nt, Artificial Sequence
  Marburg virus siRNA sense strand
auagcucaaaugcaaaaaacu

SEQ ID NO: 37817 - RNA, 21 nt, Artificial Sequence
  Marburg virus siRNA sense strand
uagcucaaaugcaaaaaacuc

SEQ ID NO: 37818 - RNA, 21 nt, Artificial Sequence
  Marburg virus siRNA sense strand
agcucaaaugcaaaaaacuca

SEQ ID NO: 37819 - RNA, 21 nt, Artificial Sequence
  Marburg virus siRNA sense strand
gcucaaaugcaaaaaacucag

SEQ ID NO: 37820 - RNA, 21 nt, Artificial Sequence
  Marburg virus siRNA sense strand
cucaaaugcaaaaaacucaga

SEQ ID NO: 37821 - RNA, 21 nt, Artificial Sequence
  Marburg virus siRNA sense strand
ucaaaugcaaaaaacucagaa

SEQ ID NO: 37822 - RNA, 21 nt, Artificial Sequence
  Marburg virus siRNA sense strand
caaaugcaaaaaacucagaau

SEQ ID NO: 37823 - RNA, 21 nt, Artificial Sequence
  Marburg virus siRNA sense strand
aaaugcaaaaaacucagaaug

SEQ ID NO: 37824 - RNA, 21 nt, Artificial Sequence
  Marburg virus siRNA sense strand
aaugcaaaaaacucagaaugg

SEQ ID NO: 37825 - RNA, 21 nt, Artificial Sequence
  Marburg virus siRNA sense strand
augcaaaaaacucagaauggu

SEQ ID NO: 37826 - RNA, 21 nt, Artificial Sequence
  Marburg virus siRNA sense strand
ugcaaaaaacucagaauggua

SEQ ID NO: 37827 - RNA, 21 nt, Artificial Sequence
  Marburg virus siRNA sense strand
gcaaaaaacucagaaugguac

SEQ ID NO: 37828 - RNA, 21 nt, Artificial Sequence
  Marburg virus siRNA sense strand
caaaaaacucagaaugguacu

SEQ ID NO: 37829 - RNA, 21 nt, Artificial Sequence
  Marburg virus siRNA sense strand
aaaaaacucagaaugguacuu

SEQ ID NO: 37830 - RNA, 21 nt, Artificial Sequence
  Marburg virus siRNA sense strand
aaaaacucagaaugguacuug

SEQ ID NO: 37831 - RNA, 21 nt, Artificial Sequence
  Marburg virus siRNA sense strand
aaaacucagaaugguacuugu

SEQ ID NO: 37832 - RNA, 21 nt, Artificial Sequence
  Marburg virus siRNA sense strand
aaacucagaaugguacuugug

SEQ ID NO: 37833 - RNA, 21 nt, Artificial Sequence
  Marburg virus siRNA sense strand
aacucagaaugguacuugugu

SEQ ID NO: 37834 - RNA, 21 nt, Artificial Sequence
  Marburg virus siRNA sense strand
acucagaaugguacuuguguu

SEQ ID NO: 37835 - RNA, 21 nt, Artificial Sequence
  Marburg virus siRNA sense strand
cucagaaugguacuuguguug

SEQ ID NO: 37836 - RNA, 21 nt, Artificial Sequence
  Marburg virus siRNA sense strand
ucagaaugguacuuguguugc

SEQ ID NO: 37837 - RNA, 21 nt, Artificial Sequence
  Marburg virus siRNA sense strand
cagaaugguacuuguguugcg

SEQ ID NO: 37838 - RNA, 21 nt, Artificial Sequence
  Marburg virus siRNA sense strand
agaaugguacuuguguugcgg

SEQ ID NO: 37839 - RNA, 21 nt, Artificial Sequence
  Marburg virus siRNA sense strand
gaaugguacuuguguugcggu

SEQ ID NO: 37840 - RNA, 21 nt, Artificial Sequence
  Marburg virus siRNA sense strand
aaugguacuuguguugcggua

SEQ ID NO: 37841 - RNA, 21 nt, Artificial Sequence
  Marburg virus siRNA sense strand
augguacuuguguugcgguaa

SEQ ID NO: 37842 - RNA, 21 nt, Artificial Sequence
  Marburg virus siRNA sense strand
ugguacuuguguugcgguaaa

SEQ ID NO: 37843 - RNA, 21 nt, Artificial Sequence
  Marburg virus siRNA sense strand
gguacuuguguugcgguaaac

SEQ ID NO: 37844 - RNA, 21 nt, Artificial Sequence
  Marburg virus siRNA sense strand
guacuuguguugcgguaaacg

SEQ ID NO: 37845 - RNA, 21 nt, Artificial Sequence
  Marburg virus siRNA sense strand
uacuuguguugcgguaaacga

SEQ ID NO: 37846 - RNA, 21 nt, Artificial Sequence
  Marburg virus siRNA sense strand
acuuguguugcgguaaacgaa

SEQ ID NO: 37847 - RNA, 21 nt, Artificial Sequence
  Marburg virus siRNA sense strand
cuuguguugcgguaaacgaag

SEQ ID NO: 37848 - RNA, 21 nt, Artificial Sequence
  Marburg virus siRNA sense strand
uuguguugcgguaaacgaaga

SEQ ID NO: 37849 - RNA, 21 nt, Artificial Sequence
  Marburg virus siRNA sense strand
uguguugcgguaaacgaagaa

SEQ ID NO: 37850 - RNA, 21 nt, Artificial Sequence
  Marburg virus siRNA sense strand
guguugcgguaaacgaagaau

SEQ ID NO: 37851 - RNA, 21 nt, Artificial Sequence
  Marburg virus siRNA sense strand
uguugcgguaaacgaagaauu

SEQ ID NO: 37852 - RNA, 21 nt, Artificial Sequence
  Marburg virus siRNA sense strand
guugcgguaaacgaagaauuc

SEQ ID NO: 37853 - RNA, 21 nt, Artificial Sequence
  Marburg virus siRNA sense strand
uugcgguaaacgaagaauuca

SEQ ID NO: 37854 - RNA, 21 nt, Artificial Sequence
  Marburg virus siRNA sense strand
ugcgguaaacgaagaauucaa

SEQ ID NO: 37855 - RNA, 21 nt, Artificial Sequence
  Marburg virus siRNA sense strand
gcgguaaacgaagaauucaac

SEQ ID NO: 37856 - RNA, 21 nt, Artificial Sequence
  Marburg virus siRNA sense strand
cgguaaacgaagaauucaacg

SEQ ID NO: 37857 - RNA, 21 nt, Artificial Sequence
  Marburg virus siRNA sense strand
gguaaacgaagaauucaacga

SEQ ID NO: 37858 - RNA, 21 nt, Artificial Sequence
  Marburg virus siRNA sense strand
guaaacgaagaauucaacgac

SEQ ID NO: 37859 - RNA, 21 nt, Artificial Sequence
  Marburg virus siRNA sense strand
uaaacgaagaauucaacgacu

SEQ ID NO: 37860 - RNA, 21 nt, Artificial Sequence
  Marburg virus siRNA sense strand
aaacgaagaauucaacgacuc

SEQ ID NO: 37861 - RNA, 21 nt, Artificial Sequence
  Marburg virus siRNA sense strand
aacgaagaauucaacgacuca

SEQ ID NO: 37862 - RNA, 21 nt, Artificial Sequence
  Marburg virus siRNA sense strand
acgaagaauucaacgacucaa

SEQ ID NO: 37863 - RNA, 21 nt, Artificial Sequence
  Marburg virus siRNA sense strand
cgaagaauucaacgacucaaa

SEQ ID NO: 37864 - RNA, 21 nt, Artificial Sequence
  Marburg virus siRNA sense strand
gaagaauucaacgacucaaaa

SEQ ID NO: 37865 - RNA, 21 nt, Artificial Sequence
  Marburg virus siRNA sense strand
aagaauucaacgacucaaaau

SEQ ID NO: 37866 - RNA, 21 nt, Artificial Sequence
  Marburg virus siRNA sense strand
agaauucaacgacucaaaauu

SEQ ID NO: 37867 - RNA, 21 nt, Artificial Sequence
  Marburg virus siRNA sense strand
gaauucaacgacucaaaauug

SEQ ID NO: 37868 - RNA, 21 nt, Artificial Sequence
  Marburg virus siRNA sense strand
aauucaacgacucaaaauuga

SEQ ID NO: 37869 - RNA, 21 nt, Artificial Sequence
  Marburg virus siRNA sense strand
auucaacgacucaaaauugau

SEQ ID NO: 37870 - RNA, 21 nt, Artificial Sequence
  Marburg virus siRNA sense strand
uucaacgacucaaaauugauu

SEQ ID NO: 37871 - RNA, 21 nt, Artificial Sequence
  Marburg virus siRNA sense strand
ucaacgacucaaaauugauuu

SEQ ID NO: 37872 - RNA, 21 nt, Artificial Sequence
  Marburg virus siRNA sense strand
caacgacucaaaauugauuuc

SEQ ID NO: 37873 - RNA, 21 nt, Artificial Sequence
  Marburg virus siRNA sense strand
aacgacucaaaauugauuucu

SEQ ID NO: 37874 - RNA, 21 nt, Artificial Sequence
  Marburg virus siRNA sense strand
acgacucaaaauugauuucuc

SEQ ID NO: 37875 - RNA, 21 nt, Artificial Sequence
  Marburg virus siRNA sense strand
cgacucaaaauugauuucuca

SEQ ID NO: 37876 - RNA, 21 nt, Artificial Sequence
  Marburg virus siRNA sense strand
gacucaaaauugauuucucag

SEQ ID NO: 37877 - RNA, 21 nt, Artificial Sequence
  Marburg virus siRNA sense strand
acucaaaauugauuucucaga

SEQ ID NO: 37878 - RNA, 21 nt, Artificial Sequence
  Marburg virus siRNA sense strand
cucaaaauugauuucucagac

SEQ ID NO: 37879 - RNA, 21 nt, Artificial Sequence
  Marburg virus siRNA sense strand
ucaaaauugauuucucagacc

SEQ ID NO: 37880 - RNA, 21 nt, Artificial Sequence
  Marburg virus siRNA sense strand
caaaauugauuucucagacca

SEQ ID NO: 37881 - RNA, 21 nt, Artificial Sequence
  Marburg virus siRNA sense strand
aaaauugauuucucagaccag

SEQ ID NO: 37882 - RNA, 21 nt, Artificial Sequence
  Marburg virus siRNA sense strand
aaauugauuucucagaccagg

SEQ ID NO: 37883 - RNA, 21 nt, Artificial Sequence
  Marburg virus siRNA sense strand
aauugauuucucagaccaggu

SEQ ID NO: 37884 - RNA, 21 nt, Artificial Sequence
  Marburg virus siRNA sense strand
auugauuucucagaccaggua

SEQ ID NO: 37885 - RNA, 21 nt, Artificial Sequence
  Marburg virus siRNA sense strand
uugauuucucagaccagguag

SEQ ID NO: 37886 - RNA, 21 nt, Artificial Sequence
  Marburg virus siRNA sense strand
ugauuucucagaccagguagg

SEQ ID NO: 37887 - RNA, 21 nt, Artificial Sequence
  Marburg virus siRNA sense strand
gauuucucagaccagguagga

SEQ ID NO: 37888 - RNA, 21 nt, Artificial Sequence
  Marburg virus siRNA sense strand
auuucucagaccagguaggaa

SEQ ID NO: 37889 - RNA, 21 nt, Artificial Sequence
  Marburg virus siRNA sense strand
uuucucagaccagguaggaau

SEQ ID NO: 37890 - RNA, 21 nt, Artificial Sequence
  Marburg virus siRNA sense strand
uucucagaccagguaggaauu

SEQ ID NO: 37891 - RNA, 21 nt, Artificial Sequence
  Marburg virus siRNA sense strand
ucucagaccagguaggaauuu

SEQ ID NO: 37892 - RNA, 21 nt, Artificial Sequence
  Marburg virus siRNA sense strand
cucagaccagguaggaauuuu

SEQ ID NO: 37893 - RNA, 21 nt, Artificial Sequence
  Marburg virus siRNA sense strand
ucagaccagguaggaauuuuu

SEQ ID NO: 37894 - RNA, 21 nt, Artificial Sequence
  Marburg virus siRNA sense strand
cagaccagguaggaauuuuuc

SEQ ID NO: 37895 - RNA, 21 nt, Artificial Sequence
  Marburg virus siRNA sense strand
agaccagguaggaauuuuucu

SEQ ID NO: 37896 - RNA, 21 nt, Artificial Sequence
  Marburg virus siRNA sense strand
gaccagguaggaauuuuucug

SEQ ID NO: 37897 - RNA, 21 nt, Artificial Sequence
  Marburg virus siRNA sense strand
accagguaggaauuuuucuga

SEQ ID NO: 37898 - RNA, 21 nt, Artificial Sequence
  Marburg virus siRNA sense strand
ccagguaggaauuuuucugau

SEQ ID NO: 37899 - RNA, 21 nt, Artificial Sequence
  Marburg virus siRNA sense strand
cagguaggaauuuuucugauu

SEQ ID NO: 37900 - RNA, 21 nt, Artificial Sequence
  Marburg virus siRNA sense strand
agguaggaauuuuucugauuu

SEQ ID NO: 37901 - RNA, 21 nt, Artificial Sequence
  Marburg virus siRNA sense strand
gguaggaauuuuucugauuug

SEQ ID NO: 37902 - RNA, 21 nt, Artificial Sequence
  Marburg virus siRNA sense strand
guaggaauuuuucugauuugu

SEQ ID NO: 37903 - RNA, 21 nt, Artificial Sequence
  Marburg virus siRNA sense strand
uaggaauuuuucugauuugua

SEQ ID NO: 37904 - RNA, 21 nt, Artificial Sequence
  Marburg virus siRNA sense strand
aggaauuuuucugauuuguaa

SEQ ID NO: 37905 - RNA, 21 nt, Artificial Sequence
  Marburg virus siRNA sense strand
ggaauuuuucugauuuguaaa

SEQ ID NO: 37906 - RNA, 21 nt, Artificial Sequence
  Marburg virus siRNA sense strand
gaauuuuucugauuuguaaag

SEQ ID NO: 37907 - RNA, 21 nt, Artificial Sequence
  Marburg virus siRNA sense strand
aauuuuucugauuuguaaagc

SEQ ID NO: 37908 - RNA, 21 nt, Artificial Sequence
  Marburg virus siRNA sense strand
auuuuucugauuuguaaagca

SEQ ID NO: 37909 - RNA, 21 nt, Artificial Sequence
  Marburg virus siRNA sense strand
uuuuucugauuuguaaagcaa

SEQ ID NO: 37910 - RNA, 21 nt, Artificial Sequence
  Marburg virus siRNA sense strand
uuuucugauuuguaaagcaau

SEQ ID NO: 37911 - RNA, 21 nt, Artificial Sequence
  Marburg virus siRNA sense strand
uuucugauuuguaaagcaaug

SEQ ID NO: 37912 - RNA, 21 nt, Artificial Sequence
  Marburg virus siRNA sense strand
uucugauuuguaaagcaaugu

SEQ ID NO: 37913 - RNA, 21 nt, Artificial Sequence
  Marburg virus siRNA sense strand
ucugauuuguaaagcaauguc

SEQ ID NO: 37914 - RNA, 21 nt, Artificial Sequence
  Marburg virus siRNA sense strand
cugauuuguaaagcaaugucg

SEQ ID NO: 37915 - RNA, 21 nt, Artificial Sequence
  Marburg virus siRNA sense strand
ugauuuguaaagcaaugucgc

SEQ ID NO: 37916 - RNA, 21 nt, Artificial Sequence
  Marburg virus siRNA sense strand
gauuuguaaagcaaugucgcg

SEQ ID NO: 37917 - RNA, 21 nt, Artificial Sequence
  Marburg virus siRNA sense strand
auuuguaaagcaaugucgcgc

SEQ ID NO: 37918 - RNA, 21 nt, Artificial Sequence
  Marburg virus siRNA sense strand
uuuguaaagcaaugucgcgcc

SEQ ID NO: 37919 - RNA, 21 nt, Artificial Sequence
  Marburg virus siRNA sense strand
uuguaaagcaaugucgcgcca

SEQ ID NO: 37920 - RNA, 21 nt, Artificial Sequence
  Marburg virus siRNA sense strand
uguaaagcaaugucgcgccaa

SEQ ID NO: 37921 - RNA, 21 nt, Artificial Sequence
  Marburg virus siRNA sense strand
guaaagcaaugucgcgccaaa

SEQ ID NO: 37922 - RNA, 21 nt, Artificial Sequence
  Marburg virus siRNA sense strand
uaaagcaaugucgcgccaaag

SEQ ID NO: 37923 - RNA, 21 nt, Artificial Sequence
  Marburg virus siRNA sense strand
aaagcaaugucgcgccaaaga

SEQ ID NO: 37924 - RNA, 21 nt, Artificial Sequence
  Marburg virus siRNA sense strand
aagcaaugucgcgccaaagac

SEQ ID NO: 37925 - RNA, 21 nt, Artificial Sequence
  Marburg virus siRNA sense strand
agcaaugucgcgccaaagaca

SEQ ID NO: 37926 - RNA, 21 nt, Artificial Sequence
  Marburg virus siRNA sense strand
gcaaugucgcgccaaagacaa

SEQ ID NO: 37927 - RNA, 21 nt, Artificial Sequence
  Marburg virus siRNA sense strand
caaugucgcgccaaagacaag

SEQ ID NO: 37928 - RNA, 21 nt, Artificial Sequence
  Marburg virus siRNA sense strand
aaugucgcgccaaagacaagc

SEQ ID NO: 37929 - RNA, 21 nt, Artificial Sequence
  Marburg virus siRNA sense strand
augucgcgccaaagacaagca

SEQ ID NO: 37930 - RNA, 21 nt, Artificial Sequence
  Marburg virus siRNA sense strand
ugucgcgccaaagacaagcaa

SEQ ID NO: 37931 - RNA, 21 nt, Artificial Sequence
  Marburg virus siRNA sense strand
gucgcgccaaagacaagcaau

SEQ ID NO: 37932 - RNA, 21 nt, Artificial Sequence
  Marburg virus siRNA sense strand
ucgcgccaaagacaagcaauu

SEQ ID NO: 37933 - RNA, 21 nt, Artificial Sequence
  Marburg virus siRNA sense strand
cgcgccaaagacaagcaauuc

SEQ ID NO: 37934 - RNA, 21 nt, Artificial Sequence
  Marburg virus siRNA sense strand
gcgccaaagacaagcaauucc

SEQ ID NO: 37935 - RNA, 21 nt, Artificial Sequence
  Marburg virus siRNA sense strand
cgccaaagacaagcaauuccu

SEQ ID NO: 37936 - RNA, 21 nt, Artificial Sequence
  Marburg virus siRNA sense strand
gccaaagacaagcaauuccuu

SEQ ID NO: 37937 - RNA, 21 nt, Artificial Sequence
  Marburg virus siRNA sense strand
ccaaagacaagcaauuccuua

SEQ ID NO: 37938 - RNA, 21 nt, Artificial Sequence
  Marburg virus siRNA sense strand
caaagacaagcaauuccuuac

SEQ ID NO: 37939 - RNA, 21 nt, Artificial Sequence
  Marburg virus siRNA sense strand
aaagacaagcaauuccuuacu

SEQ ID NO: 37940 - RNA, 21 nt, Artificial Sequence
  Marburg virus siRNA sense strand
aagacaagcaauuccuuacug

SEQ ID NO: 37941 - RNA, 21 nt, Artificial Sequence
  Marburg virus siRNA sense strand
agacaagcaauuccuuacugg

SEQ ID NO: 37942 - RNA, 21 nt, Artificial Sequence
  Marburg virus siRNA sense strand
gacaagcaauuccuuacuggu

SEQ ID NO: 37943 - RNA, 21 nt, Artificial Sequence
  Marburg virus siRNA sense strand
acaagcaauuccuuacugguu

SEQ ID NO: 37944 - RNA, 21 nt, Artificial Sequence
  Marburg virus siRNA sense strand
caagcaauuccuuacugguua

SEQ ID NO: 37945 - RNA, 21 nt, Artificial Sequence
  Marburg virus siRNA sense strand
aagcaauuccuuacugguuaa

SEQ ID NO: 37946 - RNA, 21 nt, Artificial Sequence
  Marburg virus siRNA sense strand
agcaauuccuuacugguuaaa

SEQ ID NO: 37947 - RNA, 21 nt, Artificial Sequence
  Marburg virus siRNA sense strand
gcaauuccuuacugguuaaaa

SEQ ID NO: 37948 - RNA, 21 nt, Artificial Sequence
  Marburg virus siRNA sense strand
caauuccuuacugguuaaaac

SEQ ID NO: 37949 - RNA, 21 nt, Artificial Sequence
  Marburg virus siRNA sense strand
aauuccuuacugguuaaaaca

SEQ ID NO: 37950 - RNA, 21 nt, Artificial Sequence
  Marburg virus siRNA sense strand
auuccuuacugguuaaaacau

SEQ ID NO: 37951 - RNA, 21 nt, Artificial Sequence
  Marburg virus siRNA sense strand
uuccuuacugguuaaaacaua

SEQ ID NO: 37952 - RNA, 21 nt, Artificial Sequence
  Marburg virus siRNA sense strand
uccuuacugguuaaaacauau

SEQ ID NO: 37953 - RNA, 21 nt, Artificial Sequence
  Marburg virus siRNA sense strand
ccuuacugguuaaaacauaua

SEQ ID NO: 37954 - RNA, 21 nt, Artificial Sequence
  Marburg virus siRNA sense strand
cuuacugguuaaaacauauag

SEQ ID NO: 37955 - RNA, 21 nt, Artificial Sequence
  Marburg virus siRNA sense strand
uuacugguuaaaacauauaga

SEQ ID NO: 37956 - RNA, 21 nt, Artificial Sequence
  Marburg virus siRNA sense strand
uacugguuaaaacauauagaa

SEQ ID NO: 37957 - RNA, 21 nt, Artificial Sequence
  Marburg virus siRNA sense strand
acugguuaaaacauauagaaa

SEQ ID NO: 37958 - RNA, 21 nt, Artificial Sequence
  Marburg virus siRNA sense strand
cugguuaaaacauauagaaaa

SEQ ID NO: 37959 - RNA, 21 nt, Artificial Sequence
  Marburg virus siRNA sense strand
ugguuaaaacauauagaaaag

SEQ ID NO: 37960 - RNA, 21 nt, Artificial Sequence
  Marburg virus siRNA sense strand
gguuaaaacauauagaaaaga

SEQ ID NO: 37961 - RNA, 21 nt, Artificial Sequence
  Marburg virus siRNA sense strand
guuaaaacauauagaaaagaa

SEQ ID NO: 37962 - RNA, 21 nt, Artificial Sequence
  Marburg virus siRNA sense strand
uuaaaacauauagaaaagaau

SEQ ID NO: 37963 - RNA, 21 nt, Artificial Sequence
  Marburg virus siRNA sense strand
uaaaacauauagaaaagaauu

SEQ ID NO: 37964 - RNA, 21 nt, Artificial Sequence
  Marburg virus siRNA sense strand
aaaacauauagaaaagaauua

SEQ ID NO: 37965 - RNA, 21 nt, Artificial Sequence
  Marburg virus siRNA sense strand
aaacauauagaaaagaauuau

SEQ ID NO: 37966 - RNA, 21 nt, Artificial Sequence
  Marburg virus siRNA sense strand
aacauauagaaaagaauuauc

SEQ ID NO: 37967 - RNA, 21 nt, Artificial Sequence
  Marburg virus siRNA sense strand
acauauagaaaagaauuaucc

SEQ ID NO: 37968 - RNA, 21 nt, Artificial Sequence
  Marburg virus siRNA sense strand
cauauagaaaagaauuauccu

SEQ ID NO: 37969 - RNA, 21 nt, Artificial Sequence
  Marburg virus siRNA sense strand
auauagaaaagaauuauccug

SEQ ID NO: 37970 - RNA, 21 nt, Artificial Sequence
  Marburg virus siRNA sense strand
uauagaaaagaauuauccugc

SEQ ID NO: 37971 - RNA, 21 nt, Artificial Sequence
  Marburg virus siRNA sense strand
auagaaaagaauuauccugcu

SEQ ID NO: 37972 - RNA, 21 nt, Artificial Sequence
  Marburg virus siRNA sense strand
uagaaaagaauuauccugcuu

SEQ ID NO: 37973 - RNA, 21 nt, Artificial Sequence
  Marburg virus siRNA sense strand
agaaaagaauuauccugcuuc

SEQ ID NO: 37974 - RNA, 21 nt, Artificial Sequence
  Marburg virus siRNA sense strand
gaaaagaauuauccugcuuca

SEQ ID NO: 37975 - RNA, 21 nt, Artificial Sequence
  Marburg virus siRNA sense strand
aaaagaauuauccugcuucau

SEQ ID NO: 37976 - RNA, 21 nt, Artificial Sequence
  Marburg virus siRNA sense strand
aaagaauuauccugcuucauu

SEQ ID NO: 37977 - RNA, 21 nt, Artificial Sequence
  Marburg virus siRNA sense strand
aagaauuauccugcuucauua

SEQ ID NO: 37978 - RNA, 21 nt, Artificial Sequence
  Marburg virus siRNA sense strand
agaauuauccugcuucauuac

SEQ ID NO: 37979 - RNA, 21 nt, Artificial Sequence
  Marburg virus siRNA sense strand
gaauuauccugcuucauuaca

SEQ ID NO: 37980 - RNA, 21 nt, Artificial Sequence
  Marburg virus siRNA sense strand
aauuauccugcuucauuacau

SEQ ID NO: 37981 - RNA, 21 nt, Artificial Sequence
  Marburg virus siRNA sense strand
auuauccugcuucauuacaua

SEQ ID NO: 37982 - RNA, 21 nt, Artificial Sequence
  Marburg virus siRNA sense strand
uuauccugcuucauuacauaa

SEQ ID NO: 37983 - RNA, 21 nt, Artificial Sequence
  Marburg virus siRNA sense strand
uauccugcuucauuacauaag

SEQ ID NO: 37984 - RNA, 21 nt, Artificial Sequence
  Marburg virus siRNA sense strand
auccugcuucauuacauaagu

SEQ ID NO: 37985 - RNA, 21 nt, Artificial Sequence
  Marburg virus siRNA sense strand
uccugcuucauuacauaaguu

SEQ ID NO: 37986 - RNA, 21 nt, Artificial Sequence
  Marburg virus siRNA sense strand
ccugcuucauuacauaaguuu

SEQ ID NO: 37987 - RNA, 21 nt, Artificial Sequence
  Marburg virus siRNA sense strand
cugcuucauuacauaaguuuu

SEQ ID NO: 37988 - RNA, 21 nt, Artificial Sequence
  Marburg virus siRNA sense strand
ugcuucauuacauaaguuuuu

SEQ ID NO: 37989 - RNA, 21 nt, Artificial Sequence
  Marburg virus siRNA sense strand
gcuucauuacauaaguuuuuc

SEQ ID NO: 37990 - RNA, 21 nt, Artificial Sequence
  Marburg virus siRNA sense strand
cuucauuacauaaguuuuucc

SEQ ID NO: 37991 - RNA, 21 nt, Artificial Sequence
  Marburg virus siRNA sense strand
uucauuacauaaguuuuuccu

SEQ ID NO: 37992 - RNA, 21 nt, Artificial Sequence
  Marburg virus siRNA sense strand
ucauuacauaaguuuuuccua

SEQ ID NO: 37993 - RNA, 21 nt, Artificial Sequence
  Marburg virus siRNA sense strand
cauuacauaaguuuuuccuaa

SEQ ID NO: 37994 - RNA, 21 nt, Artificial Sequence
  Marburg virus siRNA sense strand
auuacauaaguuuuuccuaac

SEQ ID NO: 37995 - RNA, 21 nt, Artificial Sequence
  Marburg virus siRNA sense strand
uuacauaaguuuuuccuaacu

SEQ ID NO: 37996 - RNA, 21 nt, Artificial Sequence
  Marburg virus siRNA sense strand
uacauaaguuuuuccuaacuu

SEQ ID NO: 37997 - RNA, 21 nt, Artificial Sequence
  Marburg virus siRNA sense strand
acauaaguuuuuccuaacuuu

SEQ ID NO: 37998 - RNA, 21 nt, Artificial Sequence
  Marburg virus siRNA sense strand
cauaaguuuuuccuaacuuug

SEQ ID NO: 37999 - RNA, 21 nt, Artificial Sequence
  Marburg virus siRNA sense strand
auaaguuuuuccuaacuuugg

SEQ ID NO: 38000 - RNA, 21 nt, Artificial Sequence
  Marburg virus siRNA sense strand
uaaguuuuuccuaacuuuggg

SEQ ID NO: 38001 - RNA, 21 nt, Artificial Sequence
  Marburg virus siRNA sense strand
aaguuuuuccuaacuuugggu

SEQ ID NO: 38002 - RNA, 21 nt, Artificial Sequence
  Marburg virus siRNA sense strand
aguuuuuccuaacuuuggguu

SEQ ID NO: 38003 - RNA, 21 nt, Artificial Sequence
  Marburg virus siRNA sense strand
guuuuuccuaacuuuggguuu

SEQ ID NO: 38004 - RNA, 21 nt, Artificial Sequence
  Marburg virus siRNA sense strand
uuuuuccuaacuuuggguuuc

SEQ ID NO: 38005 - RNA, 21 nt, Artificial Sequence
  Marburg virus siRNA sense strand
uuuuccuaacuuuggguuucc

SEQ ID NO: 38006 - RNA, 21 nt, Artificial Sequence
  Marburg virus siRNA sense strand
uuuccuaacuuuggguuuccc

SEQ ID NO: 38007 - RNA, 21 nt, Artificial Sequence
  Marburg virus siRNA sense strand
uuccuaacuuuggguuucccu

SEQ ID NO: 38008 - RNA, 21 nt, Artificial Sequence
  Marburg virus siRNA sense strand
uccuaacuuuggguuucccuu

SEQ ID NO: 38009 - RNA, 21 nt, Artificial Sequence
  Marburg virus siRNA sense strand
ccuaacuuuggguuucccuuc

SEQ ID NO: 38010 - RNA, 21 nt, Artificial Sequence
  Marburg virus siRNA sense strand
cuaacuuuggguuucccuucu

SEQ ID NO: 38011 - RNA, 21 nt, Artificial Sequence
  Marburg virus siRNA sense strand
uaacuuuggguuucccuucuu

SEQ ID NO: 38012 - RNA, 21 nt, Artificial Sequence
  Marburg virus siRNA sense strand
aacuuuggguuucccuucuuu

SEQ ID NO: 38013 - RNA, 21 nt, Artificial Sequence
  Marburg virus siRNA sense strand
acuuuggguuucccuucuuua

SEQ ID NO: 38014 - RNA, 21 nt, Artificial Sequence
  Marburg virus siRNA sense strand
cuuuggguuucccuucuuuag

SEQ ID NO: 38015 - RNA, 21 nt, Artificial Sequence
  Marburg virus siRNA sense strand
uuuggguuucccuucuuuaga

SEQ ID NO: 38016 - RNA, 21 nt, Artificial Sequence
  Marburg virus siRNA sense strand
uuggguuucccuucuuuagag

SEQ ID NO: 38017 - RNA, 21 nt, Artificial Sequence
  Marburg virus siRNA sense strand
uggguuucccuucuuuagagu

SEQ ID NO: 38018 - RNA, 21 nt, Artificial Sequence
  Marburg virus siRNA sense strand
ggguuucccuucuuuagaguc

SEQ ID NO: 38019 - RNA, 21 nt, Artificial Sequence
  Marburg virus siRNA sense strand
gguuucccuucuuuagaguca

SEQ ID NO: 38020 - RNA, 21 nt, Artificial Sequence
  Marburg virus siRNA sense strand
guuucccuucuuuagagucau

SEQ ID NO: 38021 - RNA, 21 nt, Artificial Sequence
  Marburg virus siRNA sense strand
uuucccuucuuuagagucauc

SEQ ID NO: 38022 - RNA, 21 nt, Artificial Sequence
  Marburg virus siRNA sense strand
uucccuucuuuagagucaucu

SEQ ID NO: 38023 - RNA, 21 nt, Artificial Sequence
  Marburg virus siRNA sense strand
ucccuucuuuagagucaucuu

SEQ ID NO: 38024 - RNA, 21 nt, Artificial Sequence
  Marburg virus siRNA sense strand
cccuucuuuagagucaucuuu

SEQ ID NO: 38025 - RNA, 21 nt, Artificial Sequence
  Marburg virus siRNA sense strand
ccuucuuuagagucaucuuuc

SEQ ID NO: 38026 - RNA, 21 nt, Artificial Sequence
  Marburg virus siRNA sense strand
cuucuuuagagucaucuuucu

SEQ ID NO: 38027 - RNA, 21 nt, Artificial Sequence
  Marburg virus siRNA sense strand
uucuuuagagucaucuuucug

SEQ ID NO: 38028 - RNA, 21 nt, Artificial Sequence
  Marburg virus siRNA sense strand
ucuuuagagucaucuuucugc

SEQ ID NO: 38029 - RNA, 21 nt, Artificial Sequence
  Marburg virus siRNA sense strand
cuuuagagucaucuuucugcc

SEQ ID NO: 38030 - RNA, 21 nt, Artificial Sequence
  Marburg virus siRNA sense strand
uuuagagucaucuuucugcca

SEQ ID NO: 38031 - RNA, 21 nt, Artificial Sequence
  Marburg virus siRNA sense strand
uuagagucaucuuucugccau

SEQ ID NO: 38032 - RNA, 21 nt, Artificial Sequence
  Marburg virus siRNA sense strand
uagagucaucuuucugccauc

SEQ ID NO: 38033 - RNA, 21 nt, Artificial Sequence
  Marburg virus siRNA sense strand
agagucaucuuucugccaucg

SEQ ID NO: 38034 - RNA, 21 nt, Artificial Sequence
  Marburg virus siRNA sense strand
gagucaucuuucugccaucgu

SEQ ID NO: 38035 - RNA, 21 nt, Artificial Sequence
  Marburg virus siRNA sense strand
agucaucuuucugccaucguu

SEQ ID NO: 38036 - RNA, 21 nt, Artificial Sequence
  Marburg virus siRNA sense strand
gucaucuuucugccaucguua

SEQ ID NO: 38037 - RNA, 21 nt, Artificial Sequence
  Marburg virus siRNA sense strand
ucaucuuucugccaucguuau

SEQ ID NO: 38038 - RNA, 21 nt, Artificial Sequence
  Marburg virus siRNA sense strand
caucuuucugccaucguuaua

SEQ ID NO: 38039 - RNA, 21 nt, Artificial Sequence
  Marburg virus siRNA sense strand
aucuuucugccaucguuauac

SEQ ID NO: 38040 - RNA, 21 nt, Artificial Sequence
  Marburg virus siRNA sense strand
ucuuucugccaucguuauacu

SEQ ID NO: 38041 - RNA, 21 nt, Artificial Sequence
  Marburg virus siRNA sense strand
cuuucugccaucguuauacua

SEQ ID NO: 38042 - RNA, 21 nt, Artificial Sequence
  Marburg virus siRNA sense strand
uuucugccaucguuauacuau

SEQ ID NO: 38043 - RNA, 21 nt, Artificial Sequence
  Marburg virus siRNA sense strand
uucugccaucguuauacuauu

SEQ ID NO: 38044 - RNA, 21 nt, Artificial Sequence
  Marburg virus siRNA sense strand
ucugccaucguuauacuauuc

SEQ ID NO: 38045 - RNA, 21 nt, Artificial Sequence
  Marburg virus siRNA sense strand
cugccaucguuauacuauucc

SEQ ID NO: 38046 - RNA, 21 nt, Artificial Sequence
  Marburg virus siRNA sense strand
ugccaucguuauacuauucca

SEQ ID NO: 38047 - RNA, 21 nt, Artificial Sequence
  Marburg virus siRNA sense strand
gccaucguuauacuauuccau

SEQ ID NO: 38048 - RNA, 21 nt, Artificial Sequence
  Marburg virus siRNA sense strand
ccaucguuauacuauuccauu

SEQ ID NO: 38049 - RNA, 21 nt, Artificial Sequence
  Marburg virus siRNA sense strand
caucguuauacuauuccauuc

SEQ ID NO: 38050 - RNA, 21 nt, Artificial Sequence
  Marburg virus siRNA sense strand
aucguuauacuauuccauuca

SEQ ID NO: 38051 - RNA, 21 nt, Artificial Sequence
  Marburg virus siRNA sense strand
ucguuauacuauuccauucag

SEQ ID NO: 38052 - RNA, 21 nt, Artificial Sequence
  Marburg virus siRNA sense strand
cguuauacuauuccauucagu

SEQ ID NO: 38053 - RNA, 21 nt, Artificial Sequence
  Marburg virus siRNA sense strand
guuauacuauuccauucagug

SEQ ID NO: 38054 - RNA, 21 nt, Artificial Sequence
  Marburg virus siRNA sense strand
uuauacuauuccauucaguga

SEQ ID NO: 38055 - RNA, 21 nt, Artificial Sequence
  Marburg virus siRNA sense strand
uauacuauuccauucagugaa

SEQ ID NO: 38056 - RNA, 21 nt, Artificial Sequence
  Marburg virus siRNA sense strand
auacuauuccauucagugaag

SEQ ID NO: 38057 - RNA, 21 nt, Artificial Sequence
  Marburg virus siRNA sense strand
uacuauuccauucagugaagg

SEQ ID NO: 38058 - RNA, 21 nt, Artificial Sequence
  Marburg virus siRNA sense strand
acuauuccauucagugaagga

SEQ ID NO: 38059 - RNA, 21 nt, Artificial Sequence
  Marburg virus siRNA sense strand
cuauuccauucagugaaggaa

SEQ ID NO: 38060 - RNA, 21 nt, Artificial Sequence
  Marburg virus siRNA sense strand
uauuccauucagugaaggaaa

SEQ ID NO: 38061 - RNA, 21 nt, Artificial Sequence
  Marburg virus siRNA sense strand
auuccauucagugaaggaaag

SEQ ID NO: 38062 - RNA, 21 nt, Artificial Sequence
  Marburg virus siRNA sense strand
uuccauucagugaaggaaagg

SEQ ID NO: 38063 - RNA, 21 nt, Artificial Sequence
  Marburg virus siRNA sense strand
uccauucagugaaggaaaggc

SEQ ID NO: 38064 - RNA, 21 nt, Artificial Sequence
  Marburg virus siRNA sense strand
ccauucagugaaggaaaggcu

SEQ ID NO: 38065 - RNA, 21 nt, Artificial Sequence
  Marburg virus siRNA sense strand
cauucagugaaggaaaggcuc

SEQ ID NO: 38066 - RNA, 21 nt, Artificial Sequence
  Marburg virus siRNA sense strand
auucagugaaggaaaggcucu

SEQ ID NO: 38067 - RNA, 21 nt, Artificial Sequence
  Marburg virus siRNA sense strand
uucagugaaggaaaggcucuu

SEQ ID NO: 38068 - RNA, 21 nt, Artificial Sequence
  Marburg virus siRNA sense strand
ucagugaaggaaaggcucuuu

SEQ ID NO: 38069 - RNA, 21 nt, Artificial Sequence
  Marburg virus siRNA sense strand
cagugaaggaaaggcucuuuu

SEQ ID NO: 38070 - RNA, 21 nt, Artificial Sequence
  Marburg virus siRNA sense strand
agugaaggaaaggcucuuuuu

SEQ ID NO: 38071 - RNA, 21 nt, Artificial Sequence
  Marburg virus siRNA sense strand
gugaaggaaaggcucuuuuuc

SEQ ID NO: 38072 - RNA, 21 nt, Artificial Sequence
  Marburg virus siRNA sense strand
ugaaggaaaggcucuuuuuca

SEQ ID NO: 38073 - RNA, 21 nt, Artificial Sequence
  Marburg virus siRNA sense strand
gaaggaaaggcucuuuuucau

SEQ ID NO: 38074 - RNA, 21 nt, Artificial Sequence
  Marburg virus siRNA sense strand
aaggaaaggcucuuuuucaua

SEQ ID NO: 38075 - RNA, 21 nt, Artificial Sequence
  Marburg virus siRNA sense strand
aggaaaggcucuuuuucauaa

SEQ ID NO: 38076 - RNA, 21 nt, Artificial Sequence
  Marburg virus siRNA sense strand
ggaaaggcucuuuuucauaag

SEQ ID NO: 38077 - RNA, 21 nt, Artificial Sequence
  Marburg virus siRNA sense strand
gaaaggcucuuuuucauaagg

SEQ ID NO: 38078 - RNA, 21 nt, Artificial Sequence
  Marburg virus siRNA sense strand
aaaggcucuuuuucauaaggu

SEQ ID NO: 38079 - RNA, 21 nt, Artificial Sequence
  Marburg virus siRNA sense strand
aaggcucuuuuucauaagguc

SEQ ID NO: 38080 - RNA, 21 nt, Artificial Sequence
  Marburg virus siRNA sense strand
aggcucuuuuucauaaggucc

SEQ ID NO: 38081 - RNA, 21 nt, Artificial Sequence
  Marburg virus siRNA sense strand
ggcucuuuuucauaaggucca

SEQ ID NO: 38082 - RNA, 21 nt, Artificial Sequence
  Marburg virus siRNA sense strand
gcucuuuuucauaagguccaa

SEQ ID NO: 38083 - RNA, 21 nt, Artificial Sequence
  Marburg virus siRNA sense strand
cucuuuuucauaagguccaau

SEQ ID NO: 38084 - RNA, 21 nt, Artificial Sequence
  Marburg virus siRNA sense strand
ucuuuuucauaagguccaauc

SEQ ID NO: 38085 - RNA, 21 nt, Artificial Sequence
  Marburg virus siRNA sense strand
cuuuuucauaagguccaaucu

SEQ ID NO: 38086 - RNA, 21 nt, Artificial Sequence
  Marburg virus siRNA sense strand
uuuuucauaagguccaaucuu

SEQ ID NO: 38087 - RNA, 21 nt, Artificial Sequence
  Marburg virus siRNA sense strand
uuuucauaagguccaaucuua

SEQ ID NO: 38088 - RNA, 21 nt, Artificial Sequence
  Marburg virus siRNA sense strand
uuucauaagguccaaucuuau

SEQ ID NO: 38089 - RNA, 21 nt, Artificial Sequence
  Marburg virus siRNA sense strand
uucauaagguccaaucuuaug

SEQ ID NO: 38090 - RNA, 21 nt, Artificial Sequence
  Marburg virus siRNA sense strand
ucauaagguccaaucuuaugu

SEQ ID NO: 38091 - RNA, 21 nt, Artificial Sequence
  Marburg virus siRNA sense strand
cauaagguccaaucuuauguu

SEQ ID NO: 38092 - RNA, 21 nt, Artificial Sequence
  Marburg virus siRNA sense strand
auaagguccaaucuuauguuc

SEQ ID NO: 38093 - RNA, 21 nt, Artificial Sequence
  Marburg virus siRNA sense strand
uaagguccaaucuuauguucg

SEQ ID NO: 38094 - RNA, 21 nt, Artificial Sequence
  Marburg virus siRNA sense strand
aagguccaaucuuauguucgu

SEQ ID NO: 38095 - RNA, 21 nt, Artificial Sequence
  Marburg virus siRNA sense strand
agguccaaucuuauguucguc

SEQ ID NO: 38096 - RNA, 21 nt, Artificial Sequence
  Marburg virus siRNA sense strand
gguccaaucuuauguucguca

SEQ ID NO: 38097 - RNA, 21 nt, Artificial Sequence
  Marburg virus siRNA sense strand
guccaaucuuauguucgucaa

SEQ ID NO: 38098 - RNA, 21 nt, Artificial Sequence
  Marburg virus siRNA sense strand
uccaaucuuauguucgucaag

SEQ ID NO: 38099 - RNA, 21 nt, Artificial Sequence
  Marburg virus siRNA sense strand
ccaaucuuauguucgucaagg

SEQ ID NO: 38100 - RNA, 21 nt, Artificial Sequence
  Marburg virus siRNA sense strand
caaucuuauguucgucaaggc

SEQ ID NO: 38101 - RNA, 21 nt, Artificial Sequence
  Marburg virus siRNA sense strand
aaucuuauguucgucaaggca

SEQ ID NO: 38102 - RNA, 21 nt, Artificial Sequence
  Marburg virus siRNA sense strand
aucuuauguucgucaaggcaa

SEQ ID NO: 38103 - RNA, 21 nt, Artificial Sequence
  Marburg virus siRNA sense strand
ucuuauguucgucaaggcaaa

SEQ ID NO: 38104 - RNA, 21 nt, Artificial Sequence
  Marburg virus siRNA sense strand
cuuauguucgucaaggcaaac

SEQ ID NO: 38105 - RNA, 21 nt, Artificial Sequence
  Marburg virus siRNA sense strand
uuauguucgucaaggcaaaca

SEQ ID NO: 38106 - RNA, 21 nt, Artificial Sequence
  Marburg virus siRNA sense strand
uauguucgucaaggcaaacaa

SEQ ID NO: 38107 - RNA, 21 nt, Artificial Sequence
  Marburg virus siRNA sense strand
auguucgucaaggcaaacaac

SEQ ID NO: 38108 - RNA, 21 nt, Artificial Sequence
  Marburg virus siRNA sense strand
uguucgucaaggcaaacaaca

SEQ ID NO: 38109 - RNA, 21 nt, Artificial Sequence
  Marburg virus siRNA sense strand
guucgucaaggcaaacaacau

SEQ ID NO: 38110 - RNA, 21 nt, Artificial Sequence
  Marburg virus siRNA sense strand
uucgucaaggcaaacaacauu

SEQ ID NO: 38111 - RNA, 21 nt, Artificial Sequence
  Marburg virus siRNA sense strand
ucgucaaggcaaacaacauuu

SEQ ID NO: 38112 - RNA, 21 nt, Artificial Sequence
  Marburg virus siRNA sense strand
cgucaaggcaaacaacauuua

SEQ ID NO: 38113 - RNA, 21 nt, Artificial Sequence
  Marburg virus siRNA sense strand
gucaaggcaaacaacauuuac

SEQ ID NO: 38114 - RNA, 21 nt, Artificial Sequence
  Marburg virus siRNA sense strand
ucaaggcaaacaacauuuaca

SEQ ID NO: 38115 - RNA, 21 nt, Artificial Sequence
  Marburg virus siRNA sense strand
caaggcaaacaacauuuacau

SEQ ID NO: 38116 - RNA, 21 nt, Artificial Sequence
  Marburg virus siRNA sense strand
aaggcaaacaacauuuacauu

SEQ ID NO: 38117 - RNA, 21 nt, Artificial Sequence
  Marburg virus siRNA sense strand
aggcaaacaacauuuacauuc

SEQ ID NO: 38118 - RNA, 21 nt, Artificial Sequence
  Marburg virus siRNA sense strand
ggcaaacaacauuuacauucu

SEQ ID NO: 38119 - RNA, 21 nt, Artificial Sequence
  Marburg virus siRNA sense strand
gcaaacaacauuuacauucuc

SEQ ID NO: 38120 - RNA, 21 nt, Artificial Sequence
  Marburg virus siRNA sense strand
caaacaacauuuacauucucu

SEQ ID NO: 38121 - RNA, 21 nt, Artificial Sequence
  Marburg virus siRNA sense strand
aaacaacauuuacauucucuu

SEQ ID NO: 38122 - RNA, 21 nt, Artificial Sequence
  Marburg virus siRNA sense strand
aacaacauuuacauucucuua

SEQ ID NO: 38123 - RNA, 21 nt, Artificial Sequence
  Marburg virus siRNA sense strand
acaacauuuacauucucuuau

SEQ ID NO: 38124 - RNA, 21 nt, Artificial Sequence
  Marburg virus siRNA sense strand
caacauuuacauucucuuaug

SEQ ID NO: 38125 - RNA, 21 nt, Artificial Sequence
  Marburg virus siRNA sense strand
aacauuuacauucucuuaugu

SEQ ID NO: 38126 - RNA, 21 nt, Artificial Sequence
  Marburg virus siRNA sense strand
acauuuacauucucuuauguu

SEQ ID NO: 38127 - RNA, 21 nt, Artificial Sequence
  Marburg virus siRNA sense strand
cauuuacauucucuuauguug

SEQ ID NO: 38128 - RNA, 21 nt, Artificial Sequence
  Marburg virus siRNA sense strand
auuuacauucucuuauguugg

SEQ ID NO: 38129 - RNA, 21 nt, Artificial Sequence
  Marburg virus siRNA sense strand
uuuacauucucuuauguugga

SEQ ID NO: 38130 - RNA, 21 nt, Artificial Sequence
  Marburg virus siRNA sense strand
uuacauucucuuauguuggau

SEQ ID NO: 38131 - RNA, 21 nt, Artificial Sequence
  Marburg virus siRNA sense strand
uacauucucuuauguuggauu

SEQ ID NO: 38132 - RNA, 21 nt, Artificial Sequence
  Marburg virus siRNA sense strand
acauucucuuauguuggauua

SEQ ID NO: 38133 - RNA, 21 nt, Artificial Sequence
  Marburg virus siRNA sense strand
cauucucuuauguuggauuau

SEQ ID NO: 38134 - RNA, 21 nt, Artificial Sequence
  Marburg virus siRNA sense strand
auucucuuauguuggauuaug

SEQ ID NO: 38135 - RNA, 21 nt, Artificial Sequence
  Marburg virus siRNA sense strand
uucucuuauguuggauuauga

SEQ ID NO: 38136 - RNA, 21 nt, Artificial Sequence
  Marburg virus siRNA sense strand
ucucuuauguuggauuaugaa

SEQ ID NO: 38137 - RNA, 21 nt, Artificial Sequence
  Marburg virus siRNA sense strand
cucuuauguuggauuaugaaa

SEQ ID NO: 38138 - RNA, 21 nt, Artificial Sequence
  Marburg virus siRNA sense strand
ucuuauguuggauuaugaaaa

SEQ ID NO: 38139 - RNA, 21 nt, Artificial Sequence
  Marburg virus siRNA sense strand
cuuauguuggauuaugaaaac

SEQ ID NO: 38140 - RNA, 21 nt, Artificial Sequence
  Marburg virus siRNA sense strand
uuauguuggauuaugaaaaca

SEQ ID NO: 38141 - RNA, 21 nt, Artificial Sequence
  Marburg virus siRNA sense strand
uauguuggauuaugaaaacaa

SEQ ID NO: 38142 - RNA, 21 nt, Artificial Sequence
  Marburg virus siRNA sense strand
auguuggauuaugaaaacaau

SEQ ID NO: 38143 - RNA, 21 nt, Artificial Sequence
  Marburg virus siRNA sense strand
uguuggauuaugaaaacaauu

SEQ ID NO: 38144 - RNA, 21 nt, Artificial Sequence
  Marburg virus siRNA sense strand
guuggauuaugaaaacaauuc

SEQ ID NO: 38145 - RNA, 21 nt, Artificial Sequence
  Marburg virus siRNA sense strand
uuggauuaugaaaacaauuca

SEQ ID NO: 38146 - RNA, 21 nt, Artificial Sequence
  Marburg virus siRNA sense strand
uggauuaugaaaacaauucac

SEQ ID NO: 38147 - RNA, 21 nt, Artificial Sequence
  Marburg virus siRNA sense strand
ggauuaugaaaacaauucacc

SEQ ID NO: 38148 - RNA, 21 nt, Artificial Sequence
  Marburg virus siRNA sense strand
gauuaugaaaacaauucaccu

SEQ ID NO: 38149 - RNA, 21 nt, Artificial Sequence
  Marburg virus siRNA sense strand
auuaugaaaacaauucaccuc

SEQ ID NO: 38150 - RNA, 21 nt, Artificial Sequence
  Marburg virus siRNA sense strand
uuaugaaaacaauucaccucu

SEQ ID NO: 38151 - RNA, 21 nt, Artificial Sequence
  Marburg virus siRNA sense strand
uaugaaaacaauucaccucua

SEQ ID NO: 38152 - RNA, 21 nt, Artificial Sequence
  Marburg virus siRNA sense strand
augaaaacaauucaccucuac

SEQ ID NO: 38153 - RNA, 21 nt, Artificial Sequence
  Marburg virus siRNA sense strand
ugaaaacaauucaccucuacu

SEQ ID NO: 38154 - RNA, 21 nt, Artificial Sequence
  Marburg virus siRNA sense strand
gaaaacaauucaccucuacua

SEQ ID NO: 38155 - RNA, 21 nt, Artificial Sequence
  Marburg virus siRNA sense strand
aaaacaauucaccucuacuag

SEQ ID NO: 38156 - RNA, 21 nt, Artificial Sequence
  Marburg virus siRNA sense strand
aaacaauucaccucuacuaga

SEQ ID NO: 38157 - RNA, 21 nt, Artificial Sequence
  Marburg virus siRNA sense strand
aacaauucaccucuacuagac

SEQ ID NO: 38158 - RNA, 21 nt, Artificial Sequence
  Marburg virus siRNA sense strand
acaauucaccucuacuagacu

SEQ ID NO: 38159 - RNA, 21 nt, Artificial Sequence
  Marburg virus siRNA sense strand
caauucaccucuacuagacuu

SEQ ID NO: 38160 - RNA, 21 nt, Artificial Sequence
  Marburg virus siRNA sense strand
aauucaccucuacuagacuug

SEQ ID NO: 38161 - RNA, 21 nt, Artificial Sequence
  Marburg virus siRNA sense strand
auucaccucuacuagacuuga

SEQ ID NO: 38162 - RNA, 21 nt, Artificial Sequence
  Marburg virus siRNA sense strand
uucaccucuacuagacuugag

SEQ ID NO: 38163 - RNA, 21 nt, Artificial Sequence
  Marburg virus siRNA sense strand
ucaccucuacuagacuugaga

SEQ ID NO: 38164 - RNA, 21 nt, Artificial Sequence
  Marburg virus siRNA sense strand
caccucuacuagacuugagaa

SEQ ID NO: 38165 - RNA, 21 nt, Artificial Sequence
  Marburg virus siRNA sense strand
accucuacuagacuugagaaa

SEQ ID NO: 38166 - RNA, 21 nt, Artificial Sequence
  Marburg virus siRNA sense strand
ccucuacuagacuugagaaau

SEQ ID NO: 38167 - RNA, 21 nt, Artificial Sequence
  Marburg virus siRNA sense strand
cucuacuagacuugagaaauc

SEQ ID NO: 38168 - RNA, 21 nt, Artificial Sequence
  Marburg virus siRNA sense strand
ucuacuagacuugagaaauca

SEQ ID NO: 38169 - RNA, 21 nt, Artificial Sequence
  Marburg virus siRNA sense strand
cuacuagacuugagaaaucac

SEQ ID NO: 38170 - RNA, 21 nt, Artificial Sequence
  Marburg virus siRNA sense strand
uacuagacuugagaaaucacu

SEQ ID NO: 38171 - RNA, 21 nt, Artificial Sequence
  Marburg virus siRNA sense strand
acuagacuugagaaaucacuu

SEQ ID NO: 38172 - RNA, 21 nt, Artificial Sequence
  Marburg virus siRNA sense strand
cuagacuugagaaaucacuuu

SEQ ID NO: 38173 - RNA, 21 nt, Artificial Sequence
  Marburg virus siRNA sense strand
uagacuugagaaaucacuuua

SEQ ID NO: 38174 - RNA, 21 nt, Artificial Sequence
  Marburg virus siRNA sense strand
agacuugagaaaucacuuuau

SEQ ID NO: 38175 - RNA, 21 nt, Artificial Sequence
  Marburg virus siRNA sense strand
gacuugagaaaucacuuuauu

SEQ ID NO: 38176 - RNA, 21 nt, Artificial Sequence
  Marburg virus siRNA sense strand
acuugagaaaucacuuuauuu

SEQ ID NO: 38177 - RNA, 21 nt, Artificial Sequence
  Marburg virus siRNA sense strand
cuugagaaaucacuuuauuug

SEQ ID NO: 38178 - RNA, 21 nt, Artificial Sequence
  Marburg virus siRNA sense strand
uugagaaaucacuuuauuugc

SEQ ID NO: 38179 - RNA, 21 nt, Artificial Sequence
  Marburg virus siRNA sense strand
ugagaaaucacuuuauuugcu

SEQ ID NO: 38180 - RNA, 21 nt, Artificial Sequence
  Marburg virus siRNA sense strand
gagaaaucacuuuauuugcuc

SEQ ID NO: 38181 - RNA, 21 nt, Artificial Sequence
  Marburg virus siRNA sense strand
agaaaucacuuuauuugcuca

SEQ ID NO: 38182 - RNA, 21 nt, Artificial Sequence
  Marburg virus siRNA sense strand
gaaaucacuuuauuugcucau

SEQ ID NO: 38183 - RNA, 21 nt, Artificial Sequence
  Marburg virus siRNA sense strand
aaaucacuuuauuugcucauu

SEQ ID NO: 38184 - RNA, 21 nt, Artificial Sequence
  Marburg virus siRNA sense strand
aaucacuuuauuugcucauug

SEQ ID NO: 38185 - RNA, 21 nt, Artificial Sequence
  Marburg virus siRNA sense strand
aucacuuuauuugcucauuga

SEQ ID NO: 38186 - RNA, 21 nt, Artificial Sequence
  Marburg virus siRNA sense strand
ucacuuuauuugcucauugag

SEQ ID NO: 38187 - RNA, 21 nt, Artificial Sequence
  Marburg virus siRNA sense strand
cacuuuauuugcucauugagg

SEQ ID NO: 38188 - RNA, 21 nt, Artificial Sequence
  Marburg virus siRNA sense strand
acuuuauuugcucauugaggg

SEQ ID NO: 38189 - RNA, 21 nt, Artificial Sequence
  Marburg virus siRNA sense strand
cuuuauuugcucauugagggg

SEQ ID NO: 38190 - RNA, 21 nt, Artificial Sequence
  Marburg virus siRNA sense strand
uuuauuugcucauugagggga

SEQ ID NO: 38191 - RNA, 21 nt, Artificial Sequence
  Marburg virus siRNA sense strand
uuauuugcucauugaggggaa

SEQ ID NO: 38192 - RNA, 21 nt, Artificial Sequence
  Marburg virus siRNA sense strand
uauuugcucauugaggggaaa

SEQ ID NO: 38193 - RNA, 21 nt, Artificial Sequence
  Marburg virus siRNA sense strand
auuugcucauugaggggaaag

SEQ ID NO: 38194 - RNA, 21 nt, Artificial Sequence
  Marburg virus siRNA sense strand
uuugcucauugaggggaaaga

SEQ ID NO: 38195 - RNA, 21 nt, Artificial Sequence
  Marburg virus siRNA sense strand
uugcucauugaggggaaagau

SEQ ID NO: 38196 - RNA, 21 nt, Artificial Sequence
  Marburg virus siRNA sense strand
ugcucauugaggggaaagaua

SEQ ID NO: 38197 - RNA, 21 nt, Artificial Sequence
  Marburg virus siRNA sense strand
gcucauugaggggaaagauaa

SEQ ID NO: 38198 - RNA, 21 nt, Artificial Sequence
  Marburg virus siRNA sense strand
cucauugaggggaaagauaac

SEQ ID NO: 38199 - RNA, 21 nt, Artificial Sequence
  Marburg virus siRNA sense strand
ucauugaggggaaagauaacu

SEQ ID NO: 38200 - RNA, 21 nt, Artificial Sequence
  Marburg virus siRNA sense strand
cauugaggggaaagauaacua

SEQ ID NO: 38201 - RNA, 21 nt, Artificial Sequence
  Marburg virus siRNA sense strand
auugaggggaaagauaacuaa

SEQ ID NO: 38202 - RNA, 21 nt, Artificial Sequence
  Marburg virus siRNA sense strand
uugaggggaaagauaacuaag

SEQ ID NO: 38203 - RNA, 21 nt, Artificial Sequence
  Marburg virus siRNA sense strand
ugaggggaaagauaacuaagu

SEQ ID NO: 38204 - RNA, 21 nt, Artificial Sequence
  Marburg virus siRNA sense strand
gaggggaaagauaacuaagua

SEQ ID NO: 38205 - RNA, 21 nt, Artificial Sequence
  Marburg virus siRNA sense strand
aggggaaagauaacuaaguau

SEQ ID NO: 38206 - RNA, 21 nt, Artificial Sequence
  Marburg virus siRNA sense strand
ggggaaagauaacuaaguauu

SEQ ID NO: 38207 - RNA, 21 nt, Artificial Sequence
  Marburg virus siRNA sense strand
gggaaagauaacuaaguauua

SEQ ID NO: 38208 - RNA, 21 nt, Artificial Sequence
  Marburg virus siRNA sense strand
ggaaagauaacuaaguauuac

SEQ ID NO: 38209 - RNA, 21 nt, Artificial Sequence
  Marburg virus siRNA sense strand
gaaagauaacuaaguauuaca

SEQ ID NO: 38210 - RNA, 21 nt, Artificial Sequence
  Marburg virus siRNA sense strand
aaagauaacuaaguauuacaa

SEQ ID NO: 38211 - RNA, 21 nt, Artificial Sequence
  Marburg virus siRNA sense strand
aagauaacuaaguauuacaau

SEQ ID NO: 38212 - RNA, 21 nt, Artificial Sequence
  Marburg virus siRNA sense strand
agauaacuaaguauuacaaug

SEQ ID NO: 38213 - RNA, 21 nt, Artificial Sequence
  Marburg virus siRNA sense strand
gauaacuaaguauuacaauga

SEQ ID NO: 38214 - RNA, 21 nt, Artificial Sequence
  Marburg virus siRNA sense strand
auaacuaaguauuacaaugau

SEQ ID NO: 38215 - RNA, 21 nt, Artificial Sequence
  Marburg virus siRNA sense strand
uaacuaaguauuacaaugaua

SEQ ID NO: 38216 - RNA, 21 nt, Artificial Sequence
  Marburg virus siRNA sense strand
aacuaaguauuacaaugauau

SEQ ID NO: 38217 - RNA, 21 nt, Artificial Sequence
  Marburg virus siRNA sense strand
acuaaguauuacaaugauaua

SEQ ID NO: 38218 - RNA, 21 nt, Artificial Sequence
  Marburg virus siRNA sense strand
cuaaguauuacaaugauauau

SEQ ID NO: 38219 - RNA, 21 nt, Artificial Sequence
  Marburg virus siRNA sense strand
uaaguauuacaaugauauauu

SEQ ID NO: 38220 - RNA, 21 nt, Artificial Sequence
  Marburg virus siRNA sense strand
aaguauuacaaugauauauua

SEQ ID NO: 38221 - RNA, 21 nt, Artificial Sequence
  Marburg virus siRNA sense strand
aguauuacaaugauauauuaa

SEQ ID NO: 38222 - RNA, 21 nt, Artificial Sequence
  Marburg virus siRNA sense strand
guauuacaaugauauauuaaa

SEQ ID NO: 38223 - RNA, 21 nt, Artificial Sequence
  Marburg virus siRNA sense strand
uauuacaaugauauauuaaag

SEQ ID NO: 38224 - RNA, 21 nt, Artificial Sequence
  Marburg virus siRNA sense strand
auuacaaugauauauuaaagu

SEQ ID NO: 38225 - RNA, 21 nt, Artificial Sequence
  Marburg virus siRNA sense strand
uuacaaugauauauuaaaguu

SEQ ID NO: 38226 - RNA, 21 nt, Artificial Sequence
  Marburg virus siRNA sense strand
uacaaugauauauuaaaguua

SEQ ID NO: 38227 - RNA, 21 nt, Artificial Sequence
  Marburg virus siRNA sense strand
acaaugauauauuaaaguuaa

SEQ ID NO: 38228 - RNA, 21 nt, Artificial Sequence
  Marburg virus siRNA sense strand
caaugauauauuaaaguuaaa

SEQ ID NO: 38229 - RNA, 21 nt, Artificial Sequence
  Marburg virus siRNA sense strand
aaugauauauuaaaguuaaau

SEQ ID NO: 38230 - RNA, 21 nt, Artificial Sequence
  Marburg virus siRNA sense strand
augauauauuaaaguuaaauc

SEQ ID NO: 38231 - RNA, 21 nt, Artificial Sequence
  Marburg virus siRNA sense strand
ugauauauuaaaguuaaaucu

SEQ ID NO: 38232 - RNA, 21 nt, Artificial Sequence
  Marburg virus siRNA sense strand
gauauauuaaaguuaaaucua

SEQ ID NO: 38233 - RNA, 21 nt, Artificial Sequence
  Marburg virus siRNA sense strand
auauauuaaaguuaaaucuag

SEQ ID NO: 38234 - RNA, 21 nt, Artificial Sequence
  Marburg virus siRNA sense strand
uauauuaaaguuaaaucuagu

SEQ ID NO: 38235 - RNA, 21 nt, Artificial Sequence
  Marburg virus siRNA sense strand
auauuaaaguuaaaucuaguu

SEQ ID NO: 38236 - RNA, 21 nt, Artificial Sequence
  Marburg virus siRNA sense strand
uauuaaaguuaaaucuaguua

SEQ ID NO: 38237 - RNA, 21 nt, Artificial Sequence
  Marburg virus siRNA sense strand
auuaaaguuaaaucuaguuau

SEQ ID NO: 38238 - RNA, 21 nt, Artificial Sequence
  Marburg virus siRNA sense strand
uuaaaguuaaaucuaguuauc

SEQ ID NO: 38239 - RNA, 21 nt, Artificial Sequence
  Marburg virus siRNA sense strand
uaaaguuaaaucuaguuauca

SEQ ID NO: 38240 - RNA, 21 nt, Artificial Sequence
  Marburg virus siRNA sense strand
aaaguuaaaucuaguuaucaa

SEQ ID NO: 38241 - RNA, 21 nt, Artificial Sequence
  Marburg virus siRNA sense strand
aaguuaaaucuaguuaucaag

SEQ ID NO: 38242 - RNA, 21 nt, Artificial Sequence
  Marburg virus siRNA sense strand
aguuaaaucuaguuaucaagg

SEQ ID NO: 38243 - RNA, 21 nt, Artificial Sequence
  Marburg virus siRNA sense strand
guuaaaucuaguuaucaaggc

SEQ ID NO: 38244 - RNA, 21 nt, Artificial Sequence
  Marburg virus siRNA sense strand
uuaaaucuaguuaucaaggca

SEQ ID NO: 38245 - RNA, 21 nt, Artificial Sequence
  Marburg virus siRNA sense strand
uaaaucuaguuaucaaggcag

SEQ ID NO: 38246 - RNA, 21 nt, Artificial Sequence
  Marburg virus siRNA sense strand
aaaucuaguuaucaaggcagu

SEQ ID NO: 38247 - RNA, 21 nt, Artificial Sequence
  Marburg virus siRNA sense strand
aaucuaguuaucaaggcagua

SEQ ID NO: 38248 - RNA, 21 nt, Artificial Sequence
  Marburg virus siRNA sense strand
aucuaguuaucaaggcaguag

SEQ ID NO: 38249 - RNA, 21 nt, Artificial Sequence
  Marburg virus siRNA sense strand
ucuaguuaucaaggcaguaga

SEQ ID NO: 38250 - RNA, 21 nt, Artificial Sequence
  Marburg virus siRNA sense strand
cuaguuaucaaggcaguagag

SEQ ID NO: 38251 - RNA, 21 nt, Artificial Sequence
  Marburg virus siRNA sense strand
uaguuaucaaggcaguagaga

SEQ ID NO: 38252 - RNA, 21 nt, Artificial Sequence
  Marburg virus siRNA sense strand
aguuaucaaggcaguagagaa

SEQ ID NO: 38253 - RNA, 21 nt, Artificial Sequence
  Marburg virus siRNA sense strand
guuaucaaggcaguagagaaa

SEQ ID NO: 38254 - RNA, 21 nt, Artificial Sequence
  Marburg virus siRNA sense strand
uuaucaaggcaguagagaaag

SEQ ID NO: 38255 - RNA, 21 nt, Artificial Sequence
  Marburg virus siRNA sense strand
uaucaaggcaguagagaaagg

SEQ ID NO: 38256 - RNA, 21 nt, Artificial Sequence
  Marburg virus siRNA sense strand
aucaaggcaguagagaaaggu

SEQ ID NO: 38257 - RNA, 21 nt, Artificial Sequence
  Marburg virus siRNA sense strand
ucaaggcaguagagaaaggua

SEQ ID NO: 38258 - RNA, 21 nt, Artificial Sequence
  Marburg virus siRNA sense strand
caaggcaguagagaaagguaa

SEQ ID NO: 38259 - RNA, 21 nt, Artificial Sequence
  Marburg virus siRNA sense strand
aaggcaguagagaaagguaaa

SEQ ID NO: 38260 - RNA, 21 nt, Artificial Sequence
  Marburg virus siRNA sense strand
aggcaguagagaaagguaaaa

SEQ ID NO: 38261 - RNA, 21 nt, Artificial Sequence
  Marburg virus siRNA sense strand
ggcaguagagaaagguaaaaa

SEQ ID NO: 38262 - RNA, 21 nt, Artificial Sequence
  Marburg virus siRNA sense strand
gcaguagagaaagguaaaaau

SEQ ID NO: 38263 - RNA, 21 nt, Artificial Sequence
  Marburg virus siRNA sense strand
caguagagaaagguaaaaauu

SEQ ID NO: 38264 - RNA, 21 nt, Artificial Sequence
  Marburg virus siRNA sense strand
aguagagaaagguaaaaauug

SEQ ID NO: 38265 - RNA, 21 nt, Artificial Sequence
  Marburg virus siRNA sense strand
guagagaaagguaaaaauugg

SEQ ID NO: 38266 - RNA, 21 nt, Artificial Sequence
  Marburg virus siRNA sense strand
uagagaaagguaaaaauuggu

SEQ ID NO: 38267 - RNA, 21 nt, Artificial Sequence
  Marburg virus siRNA sense strand
agagaaagguaaaaauugguc

SEQ ID NO: 38268 - RNA, 21 nt, Artificial Sequence
  Marburg virus siRNA sense strand
gagaaagguaaaaauugguca

SEQ ID NO: 38269 - RNA, 21 nt, Artificial Sequence
  Marburg virus siRNA sense strand
agaaagguaaaaauuggucac

SEQ ID NO: 38270 - RNA, 21 nt, Artificial Sequence
  Marburg virus siRNA sense strand
gaaagguaaaaauuggucaca

SEQ ID NO: 38271 - RNA, 21 nt, Artificial Sequence
  Marburg virus siRNA sense strand
aaagguaaaaauuggucacaa

SEQ ID NO: 38272 - RNA, 21 nt, Artificial Sequence
  Marburg virus siRNA sense strand
aagguaaaaauuggucacaac

SEQ ID NO: 38273 - RNA, 21 nt, Artificial Sequence
  Marburg virus siRNA sense strand
agguaaaaauuggucacaacu

SEQ ID NO: 38274 - RNA, 21 nt, Artificial Sequence
  Marburg virus siRNA sense strand
gguaaaaauuggucacaacuu

SEQ ID NO: 38275 - RNA, 21 nt, Artificial Sequence
  Marburg virus siRNA sense strand
guaaaaauuggucacaacuug

SEQ ID NO: 38276 - RNA, 21 nt, Artificial Sequence
  Marburg virus siRNA sense strand
uaaaaauuggucacaacuugu

SEQ ID NO: 38277 - RNA, 21 nt, Artificial Sequence
  Marburg virus siRNA sense strand
aaaaauuggucacaacuuguu

SEQ ID NO: 38278 - RNA, 21 nt, Artificial Sequence
  Marburg virus siRNA sense strand
aaaauuggucacaacuuguug

SEQ ID NO: 38279 - RNA, 21 nt, Artificial Sequence
  Marburg virus siRNA sense strand
aaauuggucacaacuuguuga

SEQ ID NO: 38280 - RNA, 21 nt, Artificial Sequence
  Marburg virus siRNA sense strand
aauuggucacaacuuguugag

SEQ ID NO: 38281 - RNA, 21 nt, Artificial Sequence
  Marburg virus siRNA sense strand
auuggucacaacuuguugaga

SEQ ID NO: 38282 - RNA, 21 nt, Artificial Sequence
  Marburg virus siRNA sense strand
uuggucacaacuuguugagac

SEQ ID NO: 38283 - RNA, 21 nt, Artificial Sequence
  Marburg virus siRNA sense strand
uggucacaacuuguugagacc

SEQ ID NO: 38284 - RNA, 21 nt, Artificial Sequence
  Marburg virus siRNA sense strand
ggucacaacuuguugagaccc

SEQ ID NO: 38285 - RNA, 21 nt, Artificial Sequence
  Marburg virus siRNA sense strand
gucacaacuuguugagacccu

SEQ ID NO: 38286 - RNA, 21 nt, Artificial Sequence
  Marburg virus siRNA sense strand
ucacaacuuguugagacccuu

SEQ ID NO: 38287 - RNA, 21 nt, Artificial Sequence
  Marburg virus siRNA sense strand
cacaacuuguugagacccuuc

SEQ ID NO: 38288 - RNA, 21 nt, Artificial Sequence
  Marburg virus siRNA sense strand
acaacuuguugagacccuucc

SEQ ID NO: 38289 - RNA, 21 nt, Artificial Sequence
  Marburg virus siRNA sense strand
caacuuguugagacccuuccu

SEQ ID NO: 38290 - RNA, 21 nt, Artificial Sequence
  Marburg virus siRNA sense strand
aacuuguugagacccuuccua

SEQ ID NO: 38291 - RNA, 21 nt, Artificial Sequence
  Marburg virus siRNA sense strand
acuuguugagacccuuccuaa

SEQ ID NO: 38292 - RNA, 21 nt, Artificial Sequence
  Marburg virus siRNA sense strand
cuuguugagacccuuccuaau

SEQ ID NO: 38293 - RNA, 21 nt, Artificial Sequence
  Marburg virus siRNA sense strand
uuguugagacccuuccuaaua

SEQ ID NO: 38294 - RNA, 21 nt, Artificial Sequence
  Marburg virus siRNA sense strand
uguugagacccuuccuaauau

SEQ ID NO: 38295 - RNA, 21 nt, Artificial Sequence
  Marburg virus siRNA sense strand
guugagacccuuccuaauaug

SEQ ID NO: 38296 - RNA, 21 nt, Artificial Sequence
  Marburg virus siRNA sense strand
uugagacccuuccuaauaugc

SEQ ID NO: 38297 - RNA, 21 nt, Artificial Sequence
  Marburg virus siRNA sense strand
ugagacccuuccuaauaugca

SEQ ID NO: 38298 - RNA, 21 nt, Artificial Sequence
  Marburg virus siRNA sense strand
gagacccuuccuaauaugcau

SEQ ID NO: 38299 - RNA, 21 nt, Artificial Sequence
  Marburg virus siRNA sense strand
agacccuuccuaauaugcauu

SEQ ID NO: 38300 - RNA, 21 nt, Artificial Sequence
  Marburg virus siRNA sense strand
gacccuuccuaauaugcauuc

SEQ ID NO: 38301 - RNA, 21 nt, Artificial Sequence
  Marburg virus siRNA sense strand
acccuuccuaauaugcauuca

SEQ ID NO: 38302 - RNA, 21 nt, Artificial Sequence
  Marburg virus siRNA sense strand
cccuuccuaauaugcauucag

SEQ ID NO: 38303 - RNA, 21 nt, Artificial Sequence
  Marburg virus siRNA sense strand
ccuuccuaauaugcauucagu

SEQ ID NO: 38304 - RNA, 21 nt, Artificial Sequence
  Marburg virus siRNA sense strand
cuuccuaauaugcauucaguc

SEQ ID NO: 38305 - RNA, 21 nt, Artificial Sequence
  Marburg virus siRNA sense strand
uuccuaauaugcauucagucu

SEQ ID NO: 38306 - RNA, 21 nt, Artificial Sequence
  Marburg virus siRNA sense strand
uccuaauaugcauucagucug

SEQ ID NO: 38307 - RNA, 21 nt, Artificial Sequence
  Marburg virus siRNA sense strand
ccuaauaugcauucagucugc

SEQ ID NO: 38308 - RNA, 21 nt, Artificial Sequence
  Marburg virus siRNA sense strand
cuaauaugcauucagucugca

SEQ ID NO: 38309 - RNA, 21 nt, Artificial Sequence
  Marburg virus siRNA sense strand
uaauaugcauucagucugcau

SEQ ID NO: 38310 - RNA, 21 nt, Artificial Sequence
  Marburg virus siRNA sense strand
aauaugcauucagucugcaua

SEQ ID NO: 38311 - RNA, 21 nt, Artificial Sequence
  Marburg virus siRNA sense strand
auaugcauucagucugcauag

SEQ ID NO: 38312 - RNA, 21 nt, Artificial Sequence
  Marburg virus siRNA sense strand
uaugcauucagucugcauagu

SEQ ID NO: 38313 - RNA, 21 nt, Artificial Sequence
  Marburg virus siRNA sense strand
augcauucagucugcauagua

SEQ ID NO: 38314 - RNA, 21 nt, Artificial Sequence
  Marburg virus siRNA sense strand
ugcauucagucugcauaguac

SEQ ID NO: 38315 - RNA, 21 nt, Artificial Sequence
  Marburg virus siRNA sense strand
gcauucagucugcauaguaca

SEQ ID NO: 38316 - RNA, 21 nt, Artificial Sequence
  Marburg virus siRNA sense strand
cauucagucugcauaguacac

SEQ ID NO: 38317 - RNA, 21 nt, Artificial Sequence
  Marburg virus siRNA sense strand
auucagucugcauaguacacg

SEQ ID NO: 38318 - RNA, 21 nt, Artificial Sequence
  Marburg virus siRNA sense strand
uucagucugcauaguacacgu

SEQ ID NO: 38319 - RNA, 21 nt, Artificial Sequence
  Marburg virus siRNA sense strand
ucagucugcauaguacacgug

SEQ ID NO: 38320 - RNA, 21 nt, Artificial Sequence
  Marburg virus siRNA sense strand
cagucugcauaguacacgugg

SEQ ID NO: 38321 - RNA, 21 nt, Artificial Sequence
  Marburg virus siRNA sense strand
agucugcauaguacacgugga

SEQ ID NO: 38322 - RNA, 21 nt, Artificial Sequence
  Marburg virus siRNA sense strand
gucugcauaguacacguggau

SEQ ID NO: 38323 - RNA, 21 nt, Artificial Sequence
  Marburg virus siRNA sense strand
ucugcauaguacacguggauc

SEQ ID NO: 38324 - RNA, 21 nt, Artificial Sequence
  Marburg virus siRNA sense strand
cugcauaguacacguggauca

SEQ ID NO: 38325 - RNA, 21 nt, Artificial Sequence
  Marburg virus siRNA sense strand
ugcauaguacacguggaucau

SEQ ID NO: 38326 - RNA, 21 nt, Artificial Sequence
  Marburg virus siRNA sense strand
gcauaguacacguggaucaug

SEQ ID NO: 38327 - RNA, 21 nt, Artificial Sequence
  Marburg virus siRNA sense strand
cauaguacacguggaucauga

SEQ ID NO: 38328 - RNA, 21 nt, Artificial Sequence
  Marburg virus siRNA sense strand
auaguacacguggaucaugag

SEQ ID NO: 38329 - RNA, 21 nt, Artificial Sequence
  Marburg virus siRNA sense strand
uaguacacguggaucaugagu

SEQ ID NO: 38330 - RNA, 21 nt, Artificial Sequence
  Marburg virus siRNA sense strand
aguacacguggaucaugagug

SEQ ID NO: 38331 - RNA, 21 nt, Artificial Sequence
  Marburg virus siRNA sense strand
guacacguggaucaugagugc

SEQ ID NO: 38332 - RNA, 21 nt, Artificial Sequence
  Marburg virus siRNA sense strand
uacacguggaucaugagugcu

SEQ ID NO: 38333 - RNA, 21 nt, Artificial Sequence
  Marburg virus siRNA sense strand
acacguggaucaugagugcuu

SEQ ID NO: 38334 - RNA, 21 nt, Artificial Sequence
  Marburg virus siRNA sense strand
cacguggaucaugagugcuuu

SEQ ID NO: 38335 - RNA, 21 nt, Artificial Sequence
  Marburg virus siRNA sense strand
acguggaucaugagugcuuug

SEQ ID NO: 38336 - RNA, 21 nt, Artificial Sequence
  Marburg virus siRNA sense strand
cguggaucaugagugcuuugg

SEQ ID NO: 38337 - RNA, 21 nt, Artificial Sequence
  Marburg virus siRNA sense strand
guggaucaugagugcuuugga

SEQ ID NO: 38338 - RNA, 21 nt, Artificial Sequence
  Marburg virus siRNA sense strand
uggaucaugagugcuuuggau

SEQ ID NO: 38339 - RNA, 21 nt, Artificial Sequence
  Marburg virus siRNA sense strand
ggaucaugagugcuuuggaug

SEQ ID NO: 38340 - RNA, 21 nt, Artificial Sequence
  Marburg virus siRNA sense strand
gaucaugagugcuuuggaugu

SEQ ID NO: 38341 - RNA, 21 nt, Artificial Sequence
  Marburg virus siRNA sense strand
aucaugagugcuuuggaugug

SEQ ID NO: 38342 - RNA, 21 nt, Artificial Sequence
  Marburg virus siRNA sense strand
ucaugagugcuuuggauguga

SEQ ID NO: 38343 - RNA, 21 nt, Artificial Sequence
  Marburg virus siRNA sense strand
caugagugcuuuggaugugag

SEQ ID NO: 38344 - RNA, 21 nt, Artificial Sequence
  Marburg virus siRNA sense strand
augagugcuuuggaugugaga

SEQ ID NO: 38345 - RNA, 21 nt, Artificial Sequence
  Marburg virus siRNA sense strand
ugagugcuuuggaugugagaa

SEQ ID NO: 38346 - RNA, 21 nt, Artificial Sequence
  Marburg virus siRNA sense strand
gagugcuuuggaugugagaaa

SEQ ID NO: 38347 - RNA, 21 nt, Artificial Sequence
  Marburg virus siRNA sense strand
agugcuuuggaugugagaaac

SEQ ID NO: 38348 - RNA, 21 nt, Artificial Sequence
  Marburg virus siRNA sense strand
gugcuuuggaugugagaaacg

SEQ ID NO: 38349 - RNA, 21 nt, Artificial Sequence
  Marburg virus siRNA sense strand
ugcuuuggaugugagaaacgg

SEQ ID NO: 38350 - RNA, 21 nt, Artificial Sequence
  Marburg virus siRNA sense strand
gcuuuggaugugagaaacggu

SEQ ID NO: 38351 - RNA, 21 nt, Artificial Sequence
  Marburg virus siRNA sense strand
cuuuggaugugagaaacgguu

SEQ ID NO: 38352 - RNA, 21 nt, Artificial Sequence
  Marburg virus siRNA sense strand
uuuggaugugagaaacgguua

SEQ ID NO: 38353 - RNA, 21 nt, Artificial Sequence
  Marburg virus siRNA sense strand
uuggaugugagaaacgguuac

SEQ ID NO: 38354 - RNA, 21 nt, Artificial Sequence
  Marburg virus siRNA sense strand
uggaugugagaaacgguuacu

SEQ ID NO: 38355 - RNA, 21 nt, Artificial Sequence
  Marburg virus siRNA sense strand
ggaugugagaaacgguuacua

SEQ ID NO: 38356 - RNA, 21 nt, Artificial Sequence
  Marburg virus siRNA sense strand
gaugugagaaacgguuacuac

SEQ ID NO: 38357 - RNA, 21 nt, Artificial Sequence
  Marburg virus siRNA sense strand
augugagaaacgguuacuacu

SEQ ID NO: 38358 - RNA, 21 nt, Artificial Sequence
  Marburg virus siRNA sense strand
ugugagaaacgguuacuacuc

SEQ ID NO: 38359 - RNA, 21 nt, Artificial Sequence
  Marburg virus siRNA sense strand
gugagaaacgguuacuacuca

SEQ ID NO: 38360 - RNA, 21 nt, Artificial Sequence
  Marburg virus siRNA sense strand
ugagaaacgguuacuacucaa

SEQ ID NO: 38361 - RNA, 21 nt, Artificial Sequence
  Marburg virus siRNA sense strand
gagaaacgguuacuacucaaa

SEQ ID NO: 38362 - RNA, 21 nt, Artificial Sequence
  Marburg virus siRNA sense strand
agaaacgguuacuacucaaau

SEQ ID NO: 38363 - RNA, 21 nt, Artificial Sequence
  Marburg virus siRNA sense strand
gaaacgguuacuacucaaauu

SEQ ID NO: 38364 - RNA, 21 nt, Artificial Sequence
  Marburg virus siRNA sense strand
aaacgguuacuacucaaauug

SEQ ID NO: 38365 - RNA, 21 nt, Artificial Sequence
  Marburg virus siRNA sense strand
aacgguuacuacucaaauugg

SEQ ID NO: 38366 - RNA, 21 nt, Artificial Sequence
  Marburg virus siRNA sense strand
acgguuacuacucaaauugga

SEQ ID NO: 38367 - RNA, 21 nt, Artificial Sequence
  Marburg virus siRNA sense strand
cgguuacuacucaaauuggau

SEQ ID NO: 38368 - RNA, 21 nt, Artificial Sequence
  Marburg virus siRNA sense strand
gguuacuacucaaauuggauu

SEQ ID NO: 38369 - RNA, 21 nt, Artificial Sequence
  Marburg virus siRNA sense strand
guuacuacucaaauuggauuu

SEQ ID NO: 38370 - RNA, 21 nt, Artificial Sequence
  Marburg virus siRNA sense strand
uuacuacucaaauuggauuuu

SEQ ID NO: 38371 - RNA, 21 nt, Artificial Sequence
  Marburg virus siRNA sense strand
uacuacucaaauuggauuuua

SEQ ID NO: 38372 - RNA, 21 nt, Artificial Sequence
  Marburg virus siRNA sense strand
acuacucaaauuggauuuuau

SEQ ID NO: 38373 - RNA, 21 nt, Artificial Sequence
  Marburg virus siRNA sense strand
cuacucaaauuggauuuuauu

SEQ ID NO: 38374 - RNA, 21 nt, Artificial Sequence
  Marburg virus siRNA sense strand
uacucaaauuggauuuuauua

SEQ ID NO: 38375 - RNA, 21 nt, Artificial Sequence
  Marburg virus siRNA sense strand
acucaaauuggauuuuauuag

SEQ ID NO: 38376 - RNA, 21 nt, Artificial Sequence
  Marburg virus siRNA sense strand
cucaaauuggauuuuauuaga

SEQ ID NO: 38377 - RNA, 21 nt, Artificial Sequence
  Marburg virus siRNA sense strand
ucaaauuggauuuuauuagaa

SEQ ID NO: 38378 - RNA, 21 nt, Artificial Sequence
  Marburg virus siRNA sense strand
caaauuggauuuuauuagaaa

SEQ ID NO: 38379 - RNA, 21 nt, Artificial Sequence
  Marburg virus siRNA sense strand
aaauuggauuuuauuagaaac

SEQ ID NO: 38380 - RNA, 21 nt, Artificial Sequence
  Marburg virus siRNA sense strand
aauuggauuuuauuagaaaca

SEQ ID NO: 38381 - RNA, 21 nt, Artificial Sequence
  Marburg virus siRNA sense strand
auuggauuuuauuagaaacac

SEQ ID NO: 38382 - RNA, 21 nt, Artificial Sequence
  Marburg virus siRNA sense strand
uuggauuuuauuagaaacaca

SEQ ID NO: 38383 - RNA, 21 nt, Artificial Sequence
  Marburg virus siRNA sense strand
uggauuuuauuagaaacacaa

SEQ ID NO: 38384 - RNA, 21 nt, Artificial Sequence
  Marburg virus siRNA sense strand
ggauuuuauuagaaacacaaa

SEQ ID NO: 38385 - RNA, 21 nt, Artificial Sequence
  Marburg virus siRNA sense strand
gauuuuauuagaaacacaaag

SEQ ID NO: 38386 - RNA, 21 nt, Artificial Sequence
  Marburg virus siRNA sense strand
auuuuauuagaaacacaaaga

SEQ ID NO: 38387 - RNA, 21 nt, Artificial Sequence
  Marburg virus siRNA sense strand
uuuuauuagaaacacaaagau

SEQ ID NO: 38388 - RNA, 21 nt, Artificial Sequence
  Marburg virus siRNA sense strand
uuuauuagaaacacaaagauc

SEQ ID NO: 38389 - RNA, 21 nt, Artificial Sequence
  Marburg virus siRNA sense strand
uuauuagaaacacaaagaucg

SEQ ID NO: 38390 - RNA, 21 nt, Artificial Sequence
  Marburg virus siRNA sense strand
uauuagaaacacaaagaucgc

SEQ ID NO: 38391 - RNA, 21 nt, Artificial Sequence
  Marburg virus siRNA sense strand
auuagaaacacaaagaucgca

SEQ ID NO: 38392 - RNA, 21 nt, Artificial Sequence
  Marburg virus siRNA sense strand
uuagaaacacaaagaucgcag

SEQ ID NO: 38393 - RNA, 21 nt, Artificial Sequence
  Marburg virus siRNA sense strand
uagaaacacaaagaucgcaga

SEQ ID NO: 38394 - RNA, 21 nt, Artificial Sequence
  Marburg virus siRNA sense strand
agaaacacaaagaucgcagaa

SEQ ID NO: 38395 - RNA, 21 nt, Artificial Sequence
  Marburg virus siRNA sense strand
gaaacacaaagaucgcagaac

SEQ ID NO: 38396 - RNA, 21 nt, Artificial Sequence
  Marburg virus siRNA sense strand
aaacacaaagaucgcagaaca

SEQ ID NO: 38397 - RNA, 21 nt, Artificial Sequence
  Marburg virus siRNA sense strand
aacacaaagaucgcagaacaa

SEQ ID NO: 38398 - RNA, 21 nt, Artificial Sequence
  Marburg virus siRNA sense strand
acacaaagaucgcagaacaaa

SEQ ID NO: 38399 - RNA, 21 nt, Artificial Sequence
  Marburg virus siRNA sense strand
cacaaagaucgcagaacaaaa

SEQ ID NO: 38400 - RNA, 21 nt, Artificial Sequence
  Marburg virus siRNA sense strand
acaaagaucgcagaacaaaaa

SEQ ID NO: 38401 - RNA, 21 nt, Artificial Sequence
  Marburg virus siRNA sense strand
caaagaucgcagaacaaaaau

SEQ ID NO: 38402 - RNA, 21 nt, Artificial Sequence
  Marburg virus siRNA sense strand
aaagaucgcagaacaaaaauu

SEQ ID NO: 38403 - RNA, 21 nt, Artificial Sequence
  Marburg virus siRNA sense strand
aagaucgcagaacaaaaauua

SEQ ID NO: 38404 - RNA, 21 nt, Artificial Sequence
  Marburg virus siRNA sense strand
agaucgcagaacaaaaauuac

SEQ ID NO: 38405 - RNA, 21 nt, Artificial Sequence
  Marburg virus siRNA sense strand
gaucgcagaacaaaaauuacu

SEQ ID NO: 38406 - RNA, 21 nt, Artificial Sequence
  Marburg virus siRNA sense strand
aucgcagaacaaaaauuacuu

SEQ ID NO: 38407 - RNA, 21 nt, Artificial Sequence
  Marburg virus siRNA sense strand
ucgcagaacaaaaauuacuua

SEQ ID NO: 38408 - RNA, 21 nt, Artificial Sequence
  Marburg virus siRNA sense strand
cgcagaacaaaaauuacuuaa

SEQ ID NO: 38409 - RNA, 21 nt, Artificial Sequence
  Marburg virus siRNA sense strand
gcagaacaaaaauuacuuaau

SEQ ID NO: 38410 - RNA, 21 nt, Artificial Sequence
  Marburg virus siRNA sense strand
cagaacaaaaauuacuuaaua

SEQ ID NO: 38411 - RNA, 21 nt, Artificial Sequence
  Marburg virus siRNA sense strand
agaacaaaaauuacuuaauag

SEQ ID NO: 38412 - RNA, 21 nt, Artificial Sequence
  Marburg virus siRNA sense strand
gaacaaaaauuacuuaauaga

SEQ ID NO: 38413 - RNA, 21 nt, Artificial Sequence
  Marburg virus siRNA sense strand
aacaaaaauuacuuaauagag

SEQ ID NO: 38414 - RNA, 21 nt, Artificial Sequence
  Marburg virus siRNA sense strand
acaaaaauuacuuaauagagu

SEQ ID NO: 38415 - RNA, 21 nt, Artificial Sequence
  Marburg virus siRNA sense strand
caaaaauuacuuaauagagua

SEQ ID NO: 38416 - RNA, 21 nt, Artificial Sequence
  Marburg virus siRNA sense strand
aaaaauuacuuaauagaguaa

SEQ ID NO: 38417 - RNA, 21 nt, Artificial Sequence
  Marburg virus siRNA sense strand
aaaauuacuuaauagaguaau

SEQ ID NO: 38418 - RNA, 21 nt, Artificial Sequence
  Marburg virus siRNA sense strand
aaauuacuuaauagaguaauc

SEQ ID NO: 38419 - RNA, 21 nt, Artificial Sequence
  Marburg virus siRNA sense strand
aauuacuuaauagaguaaucg

SEQ ID NO: 38420 - RNA, 21 nt, Artificial Sequence
  Marburg virus siRNA sense strand
auuacuuaauagaguaaucgg

SEQ ID NO: 38421 - RNA, 21 nt, Artificial Sequence
  Marburg virus siRNA sense strand
uuacuuaauagaguaaucggg

SEQ ID NO: 38422 - RNA, 21 nt, Artificial Sequence
  Marburg virus siRNA sense strand
uacuuaauagaguaaucgggu

SEQ ID NO: 38423 - RNA, 21 nt, Artificial Sequence
  Marburg virus siRNA sense strand
acuuaauagaguaaucgggua

SEQ ID NO: 38424 - RNA, 21 nt, Artificial Sequence
  Marburg virus siRNA sense strand
cuuaauagaguaaucggguau

SEQ ID NO: 38425 - RNA, 21 nt, Artificial Sequence
  Marburg virus siRNA sense strand
uuaauagaguaaucggguaua

SEQ ID NO: 38426 - RNA, 21 nt, Artificial Sequence
  Marburg virus siRNA sense strand
uaauagaguaaucggguauau

SEQ ID NO: 38427 - RNA, 21 nt, Artificial Sequence
  Marburg virus siRNA sense strand
aauagaguaaucggguauauu

SEQ ID NO: 38428 - RNA, 21 nt, Artificial Sequence
  Marburg virus siRNA sense strand
auagaguaaucggguauauuu

SEQ ID NO: 38429 - RNA, 21 nt, Artificial Sequence
  Marburg virus siRNA sense strand
uagaguaaucggguauauuuu

SEQ ID NO: 38430 - RNA, 21 nt, Artificial Sequence
  Marburg virus siRNA sense strand
agaguaaucggguauauuuua

SEQ ID NO: 38431 - RNA, 21 nt, Artificial Sequence
  Marburg virus siRNA sense strand
gaguaaucggguauauuuuau

SEQ ID NO: 38432 - RNA, 21 nt, Artificial Sequence
  Marburg virus siRNA sense strand
aguaaucggguauauuuuauu

SEQ ID NO: 38433 - RNA, 21 nt, Artificial Sequence
  Marburg virus siRNA sense strand
guaaucggguauauuuuauuc

SEQ ID NO: 38434 - RNA, 21 nt, Artificial Sequence
  Marburg virus siRNA sense strand
uaaucggguauauuuuauucu

SEQ ID NO: 38435 - RNA, 21 nt, Artificial Sequence
  Marburg virus siRNA sense strand
aaucggguauauuuuauucuu

SEQ ID NO: 38436 - RNA, 21 nt, Artificial Sequence
  Marburg virus siRNA sense strand
aucggguauauuuuauucuuu

SEQ ID NO: 38437 - RNA, 21 nt, Artificial Sequence
  Marburg virus siRNA sense strand
ucggguauauuuuauucuuuc

SEQ ID NO: 38438 - RNA, 21 nt, Artificial Sequence
  Marburg virus siRNA sense strand
cggguauauuuuauucuuucc

SEQ ID NO: 38439 - RNA, 21 nt, Artificial Sequence
  Marburg virus siRNA sense strand
ggguauauuuuauucuuuccg

SEQ ID NO: 38440 - RNA, 21 nt, Artificial Sequence
  Marburg virus siRNA sense strand
gguauauuuuauucuuuccgu

SEQ ID NO: 38441 - RNA, 21 nt, Artificial Sequence
  Marburg virus siRNA sense strand
guauauuuuauucuuuccguu

SEQ ID NO: 38442 - RNA, 21 nt, Artificial Sequence
  Marburg virus siRNA sense strand
uauauuuuauucuuuccguuc

SEQ ID NO: 38443 - RNA, 21 nt, Artificial Sequence
  Marburg virus siRNA sense strand
auauuuuauucuuuccguucg

SEQ ID NO: 38444 - RNA, 21 nt, Artificial Sequence
  Marburg virus siRNA sense strand
uauuuuauucuuuccguucgg

SEQ ID NO: 38445 - RNA, 21 nt, Artificial Sequence
  Marburg virus siRNA sense strand
auuuuauucuuuccguucggu

SEQ ID NO: 38446 - RNA, 21 nt, Artificial Sequence
  Marburg virus siRNA sense strand
uuuuauucuuuccguucgguc

SEQ ID NO: 38447 - RNA, 21 nt, Artificial Sequence
  Marburg virus siRNA sense strand
uuuauucuuuccguucggucu

SEQ ID NO: 38448 - RNA, 21 nt, Artificial Sequence
  Marburg virus siRNA sense strand
uuauucuuuccguucggucug

SEQ ID NO: 38449 - RNA, 21 nt, Artificial Sequence
  Marburg virus siRNA sense strand
uauucuuuccguucggucugu

SEQ ID NO: 38450 - RNA, 21 nt, Artificial Sequence
  Marburg virus siRNA sense strand
auucuuuccguucggucuguu

SEQ ID NO: 38451 - RNA, 21 nt, Artificial Sequence
  Marburg virus siRNA sense strand
uucuuuccguucggucuguuu

SEQ ID NO: 38452 - RNA, 21 nt, Artificial Sequence
  Marburg virus siRNA sense strand
ucuuuccguucggucuguuua

SEQ ID NO: 38453 - RNA, 21 nt, Artificial Sequence
  Marburg virus siRNA sense strand
cuuuccguucggucuguuuaa

SEQ ID NO: 38454 - RNA, 21 nt, Artificial Sequence
  Marburg virus siRNA sense strand
uuuccguucggucuguuuaaa

SEQ ID NO: 38455 - RNA, 21 nt, Artificial Sequence
  Marburg virus siRNA sense strand
uuccguucggucuguuuaaau

SEQ ID NO: 38456 - RNA, 21 nt, Artificial Sequence
  Marburg virus siRNA sense strand
uccguucggucuguuuaaauc

SEQ ID NO: 38457 - RNA, 21 nt, Artificial Sequence
  Marburg virus siRNA sense strand
ccguucggucuguuuaaaucu

SEQ ID NO: 38458 - RNA, 21 nt, Artificial Sequence
  Marburg virus siRNA sense strand
cguucggucuguuuaaaucug

SEQ ID NO: 38459 - RNA, 21 nt, Artificial Sequence
  Marburg virus siRNA sense strand
guucggucuguuuaaaucuga

SEQ ID NO: 38460 - RNA, 21 nt, Artificial Sequence
  Marburg virus siRNA sense strand
uucggucuguuuaaaucugaa

SEQ ID NO: 38461 - RNA, 21 nt, Artificial Sequence
  Marburg virus siRNA sense strand
ucggucuguuuaaaucugaau

SEQ ID NO: 38462 - RNA, 21 nt, Artificial Sequence
  Marburg virus siRNA sense strand
cggucuguuuaaaucugaauc

SEQ ID NO: 38463 - RNA, 21 nt, Artificial Sequence
  Marburg virus siRNA sense strand
ggucuguuuaaaucugaauca

SEQ ID NO: 38464 - RNA, 21 nt, Artificial Sequence
  Marburg virus siRNA sense strand
gucuguuuaaaucugaaucau

SEQ ID NO: 38465 - RNA, 21 nt, Artificial Sequence
  Marburg virus siRNA sense strand
ucuguuuaaaucugaaucauu

SEQ ID NO: 38466 - RNA, 21 nt, Artificial Sequence
  Marburg virus siRNA sense strand
cuguuuaaaucugaaucauua

SEQ ID NO: 38467 - RNA, 21 nt, Artificial Sequence
  Marburg virus siRNA sense strand
uguuuaaaucugaaucauuaa

SEQ ID NO: 38468 - RNA, 21 nt, Artificial Sequence
  Marburg virus siRNA sense strand
guuuaaaucugaaucauuaac

SEQ ID NO: 38469 - RNA, 21 nt, Artificial Sequence
  Marburg virus siRNA sense strand
uuuaaaucugaaucauuaaca

SEQ ID NO: 38470 - RNA, 21 nt, Artificial Sequence
  Marburg virus siRNA sense strand
uuaaaucugaaucauuaacag

SEQ ID NO: 38471 - RNA, 21 nt, Artificial Sequence
  Marburg virus siRNA sense strand
uaaaucugaaucauuaacagc

SEQ ID NO: 38472 - RNA, 21 nt, Artificial Sequence
  Marburg virus siRNA sense strand
aaaucugaaucauuaacagca

SEQ ID NO: 38473 - RNA, 21 nt, Artificial Sequence
  Marburg virus siRNA sense strand
aaucugaaucauuaacagcau

SEQ ID NO: 38474 - RNA, 21 nt, Artificial Sequence
  Marburg virus siRNA sense strand
aucugaaucauuaacagcaua

SEQ ID NO: 38475 - RNA, 21 nt, Artificial Sequence
  Marburg virus siRNA sense strand
ucugaaucauuaacagcauaa

SEQ ID NO: 38476 - RNA, 21 nt, Artificial Sequence
  Marburg virus siRNA sense strand
cugaaucauuaacagcauaac

SEQ ID NO: 38477 - RNA, 21 nt, Artificial Sequence
  Marburg virus siRNA sense strand
ugaaucauuaacagcauaacu

SEQ ID NO: 38478 - RNA, 21 nt, Artificial Sequence
  Marburg virus siRNA sense strand
gaaucauuaacagcauaacuu

SEQ ID NO: 38479 - RNA, 21 nt, Artificial Sequence
  Marburg virus siRNA sense strand
aaucauuaacagcauaacuuu

SEQ ID NO: 38480 - RNA, 21 nt, Artificial Sequence
  Marburg virus siRNA sense strand
aucauuaacagcauaacuuua

SEQ ID NO: 38481 - RNA, 21 nt, Artificial Sequence
  Marburg virus siRNA sense strand
ucauuaacagcauaacuuuaa

SEQ ID NO: 38482 - RNA, 21 nt, Artificial Sequence
  Marburg virus siRNA sense strand
cauuaacagcauaacuuuaac

SEQ ID NO: 38483 - RNA, 21 nt, Artificial Sequence
  Marburg virus siRNA sense strand
auuaacagcauaacuuuaaca

SEQ ID NO: 38484 - RNA, 21 nt, Artificial Sequence
  Marburg virus siRNA sense strand
uuaacagcauaacuuuaacaa

SEQ ID NO: 38485 - RNA, 21 nt, Artificial Sequence
  Marburg virus siRNA sense strand
uaacagcauaacuuuaacaaa

SEQ ID NO: 38486 - RNA, 21 nt, Artificial Sequence
  Marburg virus siRNA sense strand
aacagcauaacuuuaacaaag

SEQ ID NO: 38487 - RNA, 21 nt, Artificial Sequence
  Marburg virus siRNA sense strand
acagcauaacuuuaacaaaga

SEQ ID NO: 38488 - RNA, 21 nt, Artificial Sequence
  Marburg virus siRNA sense strand
cagcauaacuuuaacaaagag

SEQ ID NO: 38489 - RNA, 21 nt, Artificial Sequence
  Marburg virus siRNA sense strand
agcauaacuuuaacaaagaga

SEQ ID NO: 38490 - RNA, 21 nt, Artificial Sequence
  Marburg virus siRNA sense strand
gcauaacuuuaacaaagagaa

SEQ ID NO: 38491 - RNA, 21 nt, Artificial Sequence
  Marburg virus siRNA sense strand
cauaacuuuaacaaagagaac

SEQ ID NO: 38492 - RNA, 21 nt, Artificial Sequence
  Marburg virus siRNA sense strand
auaacuuuaacaaagagaacu

SEQ ID NO: 38493 - RNA, 21 nt, Artificial Sequence
  Marburg virus siRNA sense strand
uaacuuuaacaaagagaacuu

SEQ ID NO: 38494 - RNA, 21 nt, Artificial Sequence
  Marburg virus siRNA sense strand
aacuuuaacaaagagaacuuc

SEQ ID NO: 38495 - RNA, 21 nt, Artificial Sequence
  Marburg virus siRNA sense strand
acuuuaacaaagagaacuuca

SEQ ID NO: 38496 - RNA, 21 nt, Artificial Sequence
  Marburg virus siRNA sense strand
cuuuaacaaagagaacuucau

SEQ ID NO: 38497 - RNA, 21 nt, Artificial Sequence
  Marburg virus siRNA sense strand
uuuaacaaagagaacuucauu

SEQ ID NO: 38498 - RNA, 21 nt, Artificial Sequence
  Marburg virus siRNA sense strand
uuaacaaagagaacuucauuu

SEQ ID NO: 38499 - RNA, 21 nt, Artificial Sequence
  Marburg virus siRNA sense strand
uaacaaagagaacuucauuua

SEQ ID NO: 38500 - RNA, 21 nt, Artificial Sequence
  Marburg virus siRNA sense strand
aacaaagagaacuucauuuaa

SEQ ID NO: 38501 - RNA, 21 nt, Artificial Sequence
  Marburg virus siRNA sense strand
acaaagagaacuucauuuaau

SEQ ID NO: 38502 - RNA, 21 nt, Artificial Sequence
  Marburg virus siRNA sense strand
caaagagaacuucauuuaauu

SEQ ID NO: 38503 - RNA, 21 nt, Artificial Sequence
  Marburg virus siRNA sense strand
aaagagaacuucauuuaauuc

SEQ ID NO: 38504 - RNA, 21 nt, Artificial Sequence
  Marburg virus siRNA sense strand
aagagaacuucauuuaauuca

SEQ ID NO: 38505 - RNA, 21 nt, Artificial Sequence
  Marburg virus siRNA sense strand
agagaacuucauuuaauucac

SEQ ID NO: 38506 - RNA, 21 nt, Artificial Sequence
  Marburg virus siRNA sense strand
gagaacuucauuuaauucacg

SEQ ID NO: 38507 - RNA, 21 nt, Artificial Sequence
  Marburg virus siRNA sense strand
agaacuucauuuaauucacga

SEQ ID NO: 38508 - RNA, 21 nt, Artificial Sequence
  Marburg virus siRNA sense strand
gaacuucauuuaauucacgaa

SEQ ID NO: 38509 - RNA, 21 nt, Artificial Sequence
  Marburg virus siRNA sense strand
aacuucauuuaauucacgaaa

SEQ ID NO: 38510 - RNA, 21 nt, Artificial Sequence
  Marburg virus siRNA sense strand
acuucauuuaauucacgaaaa

SEQ ID NO: 38511 - RNA, 21 nt, Artificial Sequence
  Marburg virus siRNA sense strand
cuucauuuaauucacgaaaau

SEQ ID NO: 38512 - RNA, 21 nt, Artificial Sequence
  Marburg virus siRNA sense strand
uucauuuaauucacgaaaaua

SEQ ID NO: 38513 - RNA, 21 nt, Artificial Sequence
  Marburg virus siRNA sense strand
ucauuuaauucacgaaaauaa

SEQ ID NO: 38514 - RNA, 21 nt, Artificial Sequence
  Marburg virus siRNA sense strand
cauuuaauucacgaaaauaau

SEQ ID NO: 38515 - RNA, 21 nt, Artificial Sequence
  Marburg virus siRNA sense strand
auuuaauucacgaaaauaauc

SEQ ID NO: 38516 - RNA, 21 nt, Artificial Sequence
  Marburg virus siRNA sense strand
uuuaauucacgaaaauaaucu

SEQ ID NO: 38517 - RNA, 21 nt, Artificial Sequence
  Marburg virus siRNA sense strand
uuaauucacgaaaauaaucua

SEQ ID NO: 38518 - RNA, 21 nt, Artificial Sequence
  Marburg virus siRNA sense strand
uaauucacgaaaauaaucuau

SEQ ID NO: 38519 - RNA, 21 nt, Artificial Sequence
  Marburg virus siRNA sense strand
aauucacgaaaauaaucuauu

SEQ ID NO: 38520 - RNA, 21 nt, Artificial Sequence
  Marburg virus siRNA sense strand
auucacgaaaauaaucuauuu

SEQ ID NO: 38521 - RNA, 21 nt, Artificial Sequence
  Marburg virus siRNA sense strand
uucacgaaaauaaucuauuua

SEQ ID NO: 38522 - RNA, 21 nt, Artificial Sequence
  Marburg virus siRNA sense strand
ucacgaaaauaaucuauuuaa

SEQ ID NO: 38523 - RNA, 21 nt, Artificial Sequence
  Marburg virus siRNA sense strand
cacgaaaauaaucuauuuaaa

SEQ ID NO: 38524 - RNA, 21 nt, Artificial Sequence
  Marburg virus siRNA sense strand
acgaaaauaaucuauuuaaaa

SEQ ID NO: 38525 - RNA, 21 nt, Artificial Sequence
  Marburg virus siRNA sense strand
cgaaaauaaucuauuuaaaaa

SEQ ID NO: 38526 - RNA, 21 nt, Artificial Sequence
  Marburg virus siRNA sense strand
gaaaauaaucuauuuaaaaau

SEQ ID NO: 38527 - RNA, 21 nt, Artificial Sequence
  Marburg virus siRNA sense strand
aaaauaaucuauuuaaaaaug

SEQ ID NO: 38528 - RNA, 21 nt, Artificial Sequence
  Marburg virus siRNA sense strand
aaauaaucuauuuaaaaauga

SEQ ID NO: 38529 - RNA, 21 nt, Artificial Sequence
  Marburg virus siRNA sense strand
aauaaucuauuuaaaaaugag

SEQ ID NO: 38530 - RNA, 21 nt, Artificial Sequence
  Marburg virus siRNA sense strand
auaaucuauuuaaaaaugagg

SEQ ID NO: 38531 - RNA, 21 nt, Artificial Sequence
  Marburg virus siRNA sense strand
uaaucuauuuaaaaaugaggg

SEQ ID NO: 38532 - RNA, 21 nt, Artificial Sequence
  Marburg virus siRNA sense strand
aaucuauuuaaaaaugagggu

SEQ ID NO: 38533 - RNA, 21 nt, Artificial Sequence
  Marburg virus siRNA sense strand
aucuauuuaaaaaugaggguu

SEQ ID NO: 38534 - RNA, 21 nt, Artificial Sequence
  Marburg virus siRNA sense strand
ucuauuuaaaaaugaggguua

SEQ ID NO: 38535 - RNA, 21 nt, Artificial Sequence
  Marburg virus siRNA sense strand
cuauuuaaaaaugaggguuac

SEQ ID NO: 38536 - RNA, 21 nt, Artificial Sequence
  Marburg virus siRNA sense strand
uauuuaaaaaugaggguuaca

SEQ ID NO: 38537 - RNA, 21 nt, Artificial Sequence
  Marburg virus siRNA sense strand
auuuaaaaaugaggguuacau

SEQ ID NO: 38538 - RNA, 21 nt, Artificial Sequence
  Marburg virus siRNA sense strand
uuuaaaaaugaggguuacauu

SEQ ID NO: 38539 - RNA, 21 nt, Artificial Sequence
  Marburg virus siRNA sense strand
uuaaaaaugaggguuacauuu

SEQ ID NO: 38540 - RNA, 21 nt, Artificial Sequence
  Marburg virus siRNA sense strand
uaaaaaugaggguuacauuuu

SEQ ID NO: 38541 - RNA, 21 nt, Artificial Sequence
  Marburg virus siRNA sense strand
aaaaaugaggguuacauuuuc

SEQ ID NO: 38542 - RNA, 21 nt, Artificial Sequence
  Marburg virus siRNA sense strand
aaaaugaggguuacauuuucu

SEQ ID NO: 38543 - RNA, 21 nt, Artificial Sequence
  Marburg virus siRNA sense strand
aaaugaggguuacauuuucua

SEQ ID NO: 38544 - RNA, 21 nt, Artificial Sequence
  Marburg virus siRNA sense strand
aaugaggguuacauuuucuag

SEQ ID NO: 38545 - RNA, 21 nt, Artificial Sequence
  Marburg virus siRNA sense strand
augaggguuacauuuucuaga

SEQ ID NO: 38546 - RNA, 21 nt, Artificial Sequence
  Marburg virus siRNA sense strand
ugaggguuacauuuucuagag

SEQ ID NO: 38547 - RNA, 21 nt, Artificial Sequence
  Marburg virus siRNA sense strand
gaggguuacauuuucuagagu

SEQ ID NO: 38548 - RNA, 21 nt, Artificial Sequence
  Marburg virus siRNA sense strand
aggguuacauuuucuagagua

SEQ ID NO: 38549 - RNA, 21 nt, Artificial Sequence
  Marburg virus siRNA sense strand
ggguuacauuuucuagaguau

SEQ ID NO: 38550 - RNA, 21 nt, Artificial Sequence
  Marburg virus siRNA sense strand
gguuacauuuucuagaguauu

SEQ ID NO: 38551 - RNA, 21 nt, Artificial Sequence
  Marburg virus siRNA sense strand
guuacauuuucuagaguauug

SEQ ID NO: 38552 - RNA, 21 nt, Artificial Sequence
  Marburg virus siRNA sense strand
uuacauuuucuagaguauugu

SEQ ID NO: 38553 - RNA, 21 nt, Artificial Sequence
  Marburg virus siRNA sense strand
uacauuuucuagaguauugua

SEQ ID NO: 38554 - RNA, 21 nt, Artificial Sequence
  Marburg virus siRNA sense strand
acauuuucuagaguauuguau

SEQ ID NO: 38555 - RNA, 21 nt, Artificial Sequence
  Marburg virus siRNA sense strand
cauuuucuagaguauuguaug

SEQ ID NO: 38556 - RNA, 21 nt, Artificial Sequence
  Marburg virus siRNA sense strand
auuuucuagaguauuguauga

SEQ ID NO: 38557 - RNA, 21 nt, Artificial Sequence
  Marburg virus siRNA sense strand
uuuucuagaguauuguaugag

SEQ ID NO: 38558 - RNA, 21 nt, Artificial Sequence
  Marburg virus siRNA sense strand
uuucuagaguauuguaugaga

SEQ ID NO: 38559 - RNA, 21 nt, Artificial Sequence
  Marburg virus siRNA sense strand
uucuagaguauuguaugagaa

SEQ ID NO: 38560 - RNA, 21 nt, Artificial Sequence
  Marburg virus siRNA sense strand
ucuagaguauuguaugagaaa

SEQ ID NO: 38561 - RNA, 21 nt, Artificial Sequence
  Marburg virus siRNA sense strand
cuagaguauuguaugagaaau

SEQ ID NO: 38562 - RNA, 21 nt, Artificial Sequence
  Marburg virus siRNA sense strand
uagaguauuguaugagaaaua

SEQ ID NO: 38563 - RNA, 21 nt, Artificial Sequence
  Marburg virus siRNA sense strand
agaguauuguaugagaaauaa

SEQ ID NO: 38564 - RNA, 21 nt, Artificial Sequence
  Marburg virus siRNA sense strand
gaguauuguaugagaaauaau

SEQ ID NO: 38565 - RNA, 21 nt, Artificial Sequence
  Marburg virus siRNA sense strand
aguauuguaugagaaauaaua

SEQ ID NO: 38566 - RNA, 21 nt, Artificial Sequence
  Marburg virus siRNA sense strand
guauuguaugagaaauaauaa

SEQ ID NO: 38567 - RNA, 21 nt, Artificial Sequence
  Marburg virus siRNA sense strand
uauuguaugagaaauaauaaa

SEQ ID NO: 38568 - RNA, 21 nt, Artificial Sequence
  Marburg virus siRNA sense strand
auuguaugagaaauaauaaaa

SEQ ID NO: 38569 - RNA, 21 nt, Artificial Sequence
  Marburg virus siRNA sense strand
uuguaugagaaauaauaaaau

SEQ ID NO: 38570 - RNA, 21 nt, Artificial Sequence
  Marburg virus siRNA sense strand
uguaugagaaauaauaaaaua

SEQ ID NO: 38571 - RNA, 21 nt, Artificial Sequence
  Marburg virus siRNA sense strand
guaugagaaauaauaaaauaa

SEQ ID NO: 38572 - RNA, 21 nt, Artificial Sequence
  Marburg virus siRNA sense strand
uaugagaaauaauaaaauaaa

SEQ ID NO: 38573 - RNA, 21 nt, Artificial Sequence
  Marburg virus siRNA sense strand
augagaaauaauaaaauaaac

SEQ ID NO: 38574 - RNA, 21 nt, Artificial Sequence
  Marburg virus siRNA sense strand
ugagaaauaauaaaauaaaca

SEQ ID NO: 38575 - RNA, 21 nt, Artificial Sequence
  Marburg virus siRNA sense strand
gagaaauaauaaaauaaacaa

SEQ ID NO: 38576 - RNA, 21 nt, Artificial Sequence
  Marburg virus siRNA sense strand
agaaauaauaaaauaaacaag

SEQ ID NO: 38577 - RNA, 21 nt, Artificial Sequence
  Marburg virus siRNA sense strand
gaaauaauaaaauaaacaaga

SEQ ID NO: 38578 - RNA, 21 nt, Artificial Sequence
  Marburg virus siRNA sense strand
aaauaauaaaauaaacaagaa

SEQ ID NO: 38579 - RNA, 21 nt, Artificial Sequence
  Marburg virus siRNA sense strand
aauaauaaaauaaacaagaag

SEQ ID NO: 38580 - RNA, 21 nt, Artificial Sequence
  Marburg virus siRNA sense strand
auaauaaaauaaacaagaaga

SEQ ID NO: 38581 - RNA, 21 nt, Artificial Sequence
  Marburg virus siRNA sense strand
uaauaaaauaaacaagaagaa

SEQ ID NO: 38582 - RNA, 21 nt, Artificial Sequence
  Marburg virus siRNA sense strand
aauaaaauaaacaagaagaag

SEQ ID NO: 38583 - RNA, 21 nt, Artificial Sequence
  Marburg virus siRNA sense strand
auaaaauaaacaagaagaaga

SEQ ID NO: 38584 - RNA, 21 nt, Artificial Sequence
  Marburg virus siRNA sense strand
uaaaauaaacaagaagaagaa

SEQ ID NO: 38585 - RNA, 21 nt, Artificial Sequence
  Marburg virus siRNA sense strand
aaaauaaacaagaagaagaaa

SEQ ID NO: 38586 - RNA, 21 nt, Artificial Sequence
  Marburg virus siRNA sense strand
aaauaaacaagaagaagaaaa

SEQ ID NO: 38587 - RNA, 21 nt, Artificial Sequence
  Marburg virus siRNA sense strand
aauaaacaagaagaagaaaaa

SEQ ID NO: 38588 - RNA, 21 nt, Artificial Sequence
  Marburg virus siRNA sense strand
auaaacaagaagaagaaaaaa

SEQ ID NO: 38589 - RNA, 21 nt, Artificial Sequence
  Marburg virus siRNA sense strand
uaaacaagaagaagaaaaaac

SEQ ID NO: 38590 - RNA, 21 nt, Artificial Sequence
  Marburg virus siRNA sense strand
aaacaagaagaagaaaaaacu

SEQ ID NO: 38591 - RNA, 21 nt, Artificial Sequence
  Marburg virus siRNA sense strand
aacaagaagaagaaaaaacua

SEQ ID NO: 38592 - RNA, 21 nt, Artificial Sequence
  Marburg virus siRNA sense strand
acaagaagaagaaaaaacuau

SEQ ID NO: 38593 - RNA, 21 nt, Artificial Sequence
  Marburg virus siRNA sense strand
caagaagaagaaaaaacuauu

SEQ ID NO: 38594 - RNA, 21 nt, Artificial Sequence
  Marburg virus siRNA sense strand
aagaagaagaaaaaacuauua

SEQ ID NO: 38595 - RNA, 21 nt, Artificial Sequence
  Marburg virus siRNA sense strand
agaagaagaaaaaacuauuag

SEQ ID NO: 38596 - RNA, 21 nt, Artificial Sequence
  Marburg virus siRNA sense strand
gaagaagaaaaaacuauuaga

SEQ ID NO: 38597 - RNA, 21 nt, Artificial Sequence
  Marburg virus siRNA sense strand
aagaagaaaaaacuauuagac

SEQ ID NO: 38598 - RNA, 21 nt, Artificial Sequence
  Marburg virus siRNA sense strand
agaagaaaaaacuauuagaca

SEQ ID NO: 38599 - RNA, 21 nt, Artificial Sequence
  Marburg virus siRNA sense strand
gaagaaaaaacuauuagacag

SEQ ID NO: 38600 - RNA, 21 nt, Artificial Sequence
  Marburg virus siRNA sense strand
aagaaaaaacuauuagacagc

SEQ ID NO: 38601 - RNA, 21 nt, Artificial Sequence
  Marburg virus siRNA sense strand
agaaaaaacuauuagacagcu

SEQ ID NO: 38602 - RNA, 21 nt, Artificial Sequence
  Marburg virus siRNA sense strand
gaaaaaacuauuagacagcuu

SEQ ID NO: 38603 - RNA, 21 nt, Artificial Sequence
  Marburg virus siRNA sense strand
aaaaaacuauuagacagcuug

SEQ ID NO: 38604 - RNA, 21 nt, Artificial Sequence
  Marburg virus siRNA sense strand
aaaaacuauuagacagcuugc

SEQ ID NO: 38605 - RNA, 21 nt, Artificial Sequence
  Marburg virus siRNA sense strand
aaaacuauuagacagcuugcu

SEQ ID NO: 38606 - RNA, 21 nt, Artificial Sequence
  Marburg virus siRNA sense strand
aaacuauuagacagcuugcuu

SEQ ID NO: 38607 - RNA, 21 nt, Artificial Sequence
  Marburg virus siRNA sense strand
aacuauuagacagcuugcuuu

SEQ ID NO: 38608 - RNA, 21 nt, Artificial Sequence
  Marburg virus siRNA sense strand
acuauuagacagcuugcuuua

SEQ ID NO: 38609 - RNA, 21 nt, Artificial Sequence
  Marburg virus siRNA sense strand
cuauuagacagcuugcuuuac

SEQ ID NO: 38610 - RNA, 21 nt, Artificial Sequence
  Marburg virus siRNA sense strand
uauuagacagcuugcuuuaca

SEQ ID NO: 38611 - RNA, 21 nt, Artificial Sequence
  Marburg virus siRNA sense strand
auuagacagcuugcuuuacac

SEQ ID NO: 38612 - RNA, 21 nt, Artificial Sequence
  Marburg virus siRNA sense strand
uuagacagcuugcuuuacaca

SEQ ID NO: 38613 - RNA, 21 nt, Artificial Sequence
  Marburg virus siRNA sense strand
uagacagcuugcuuuacacaa

SEQ ID NO: 38614 - RNA, 21 nt, Artificial Sequence
  Marburg virus siRNA sense strand
agacagcuugcuuuacacaag

SEQ ID NO: 38615 - RNA, 21 nt, Artificial Sequence
  Marburg virus siRNA sense strand
gacagcuugcuuuacacaaga

SEQ ID NO: 38616 - RNA, 21 nt, Artificial Sequence
  Marburg virus siRNA sense strand
acagcuugcuuuacacaagau

SEQ ID NO: 38617 - RNA, 21 nt, Artificial Sequence
  Marburg virus siRNA sense strand
cagcuugcuuuacacaagaua

SEQ ID NO: 38618 - RNA, 21 nt, Artificial Sequence
  Marburg virus siRNA sense strand
agcuugcuuuacacaagauaa

SEQ ID NO: 38619 - RNA, 21 nt, Artificial Sequence
  Marburg virus siRNA sense strand
gcuugcuuuacacaagauaau

SEQ ID NO: 38620 - RNA, 21 nt, Artificial Sequence
  Marburg virus siRNA sense strand
cuugcuuuacacaagauaauc

SEQ ID NO: 38621 - RNA, 21 nt, Artificial Sequence
  Marburg virus siRNA sense strand
uugcuuuacacaagauaaucu

SEQ ID NO: 38622 - RNA, 21 nt, Artificial Sequence
  Marburg virus siRNA sense strand
ugcuuuacacaagauaaucuu

SEQ ID NO: 38623 - RNA, 21 nt, Artificial Sequence
  Marburg virus siRNA sense strand
gcuuuacacaagauaaucuua

SEQ ID NO: 38624 - RNA, 21 nt, Artificial Sequence
  Marburg virus siRNA sense strand
cuuuacacaagauaaucuuau

SEQ ID NO: 38625 - RNA, 21 nt, Artificial Sequence
  Marburg virus siRNA sense strand
uuuacacaagauaaucuuaua

SEQ ID NO: 38626 - RNA, 21 nt, Artificial Sequence
  Marburg virus siRNA sense strand
uuacacaagauaaucuuauau

SEQ ID NO: 38627 - RNA, 21 nt, Artificial Sequence
  Marburg virus siRNA sense strand
uacacaagauaaucuuauauc

SEQ ID NO: 38628 - RNA, 21 nt, Artificial Sequence
  Marburg virus siRNA sense strand
acacaagauaaucuuauaucg

SEQ ID NO: 38629 - RNA, 21 nt, Artificial Sequence
  Marburg virus siRNA sense strand
cacaagauaaucuuauaucgu

SEQ ID NO: 38630 - RNA, 21 nt, Artificial Sequence
  Marburg virus siRNA sense strand
acaagauaaucuuauaucguc

SEQ ID NO: 38631 - RNA, 21 nt, Artificial Sequence
  Marburg virus siRNA sense strand
caagauaaucuuauaucgucu

SEQ ID NO: 38632 - RNA, 21 nt, Artificial Sequence
  Marburg virus siRNA sense strand
aagauaaucuuauaucgucuc

SEQ ID NO: 38633 - RNA, 21 nt, Artificial Sequence
  Marburg virus siRNA sense strand
agauaaucuuauaucgucuca

SEQ ID NO: 38634 - RNA, 21 nt, Artificial Sequence
  Marburg virus siRNA sense strand
gauaaucuuauaucgucucaa

SEQ ID NO: 38635 - RNA, 21 nt, Artificial Sequence
  Marburg virus siRNA sense strand
auaaucuuauaucgucucaaa

SEQ ID NO: 38636 - RNA, 21 nt, Artificial Sequence
  Marburg virus siRNA sense strand
uaaucuuauaucgucucaaac

SEQ ID NO: 38637 - RNA, 21 nt, Artificial Sequence
  Marburg virus siRNA sense strand
aaucuuauaucgucucaaacc

SEQ ID NO: 38638 - RNA, 21 nt, Artificial Sequence
  Marburg virus siRNA sense strand
aucuuauaucgucucaaaccg

SEQ ID NO: 38639 - RNA, 21 nt, Artificial Sequence
  Marburg virus siRNA sense strand
ucuuauaucgucucaaaccgu

SEQ ID NO: 38640 - RNA, 21 nt, Artificial Sequence
  Marburg virus siRNA sense strand
cuuauaucgucucaaaccgua

SEQ ID NO: 38641 - RNA, 21 nt, Artificial Sequence
  Marburg virus siRNA sense strand
uuauaucgucucaaaccguac

SEQ ID NO: 38642 - RNA, 21 nt, Artificial Sequence
  Marburg virus siRNA sense strand
uauaucgucucaaaccguaca

SEQ ID NO: 38643 - RNA, 21 nt, Artificial Sequence
  Marburg virus siRNA sense strand
auaucgucucaaaccguacac

SEQ ID NO: 38644 - RNA, 21 nt, Artificial Sequence
  Marburg virus siRNA sense strand
uaucgucucaaaccguacaca

SEQ ID NO: 38645 - RNA, 21 nt, Artificial Sequence
  Marburg virus siRNA sense strand
aucgucucaaaccguacacaa

SEQ ID NO: 38646 - RNA, 21 nt, Artificial Sequence
  Marburg virus siRNA sense strand
ucgucucaaaccguacacaag

SEQ ID NO: 38647 - RNA, 21 nt, Artificial Sequence
  Marburg virus siRNA sense strand
cgucucaaaccguacacaagu

SEQ ID NO: 38648 - RNA, 21 nt, Artificial Sequence
  Marburg virus siRNA sense strand
gucucaaaccguacacaagua

SEQ ID NO: 38649 - RNA, 21 nt, Artificial Sequence
  Marburg virus siRNA sense strand
ucucaaaccguacacaaguag

SEQ ID NO: 38650 - RNA, 21 nt, Artificial Sequence
  Marburg virus siRNA sense strand
cucaaaccguacacaaguagg

SEQ ID NO: 38651 - RNA, 21 nt, Artificial Sequence
  Marburg virus siRNA sense strand
ucaaaccguacacaaguaggg

SEQ ID NO: 38652 - RNA, 21 nt, Artificial Sequence
  Marburg virus siRNA sense strand
caaaccguacacaaguaggga

SEQ ID NO: 38653 - RNA, 21 nt, Artificial Sequence
  Marburg virus siRNA sense strand
aaaccguacacaaguagggaa

SEQ ID NO: 38654 - RNA, 21 nt, Artificial Sequence
  Marburg virus siRNA sense strand
aaccguacacaaguagggaaa

SEQ ID NO: 38655 - RNA, 21 nt, Artificial Sequence
  Marburg virus siRNA sense strand
accguacacaaguagggaaau

SEQ ID NO: 38656 - RNA, 21 nt, Artificial Sequence
  Marburg virus siRNA sense strand
ccguacacaaguagggaaauc

SEQ ID NO: 38657 - RNA, 21 nt, Artificial Sequence
  Marburg virus siRNA sense strand
cguacacaaguagggaaauca

SEQ ID NO: 38658 - RNA, 21 nt, Artificial Sequence
  Marburg virus siRNA sense strand
guacacaaguagggaaaucac

SEQ ID NO: 38659 - RNA, 21 nt, Artificial Sequence
  Marburg virus siRNA sense strand
uacacaaguagggaaaucacg

SEQ ID NO: 38660 - RNA, 21 nt, Artificial Sequence
  Marburg virus siRNA sense strand
acacaaguagggaaaucacgc

SEQ ID NO: 38661 - RNA, 21 nt, Artificial Sequence
  Marburg virus siRNA sense strand
cacaaguagggaaaucacgcg

SEQ ID NO: 38662 - RNA, 21 nt, Artificial Sequence
  Marburg virus siRNA sense strand
acaaguagggaaaucacgcgc

SEQ ID NO: 38663 - RNA, 21 nt, Artificial Sequence
  Marburg virus siRNA sense strand
caaguagggaaaucacgcgca

SEQ ID NO: 38664 - RNA, 21 nt, Artificial Sequence
  Marburg virus siRNA sense strand
aaguagggaaaucacgcgcac

SEQ ID NO: 38665 - RNA, 21 nt, Artificial Sequence
  Marburg virus siRNA sense strand
aguagggaaaucacgcgcaca

SEQ ID NO: 38666 - RNA, 21 nt, Artificial Sequence
  Marburg virus siRNA sense strand
guagggaaaucacgcgcacaa

SEQ ID NO: 38667 - RNA, 21 nt, Artificial Sequence
  Marburg virus siRNA sense strand
uagggaaaucacgcgcacaaa

SEQ ID NO: 38668 - RNA, 21 nt, Artificial Sequence
  Marburg virus siRNA sense strand
agggaaaucacgcgcacaaau

SEQ ID NO: 38669 - RNA, 21 nt, Artificial Sequence
  Marburg virus siRNA sense strand
gggaaaucacgcgcacaaauu

SEQ ID NO: 38670 - RNA, 21 nt, Artificial Sequence
  Marburg virus siRNA sense strand
ggaaaucacgcgcacaaauua

SEQ ID NO: 38671 - RNA, 21 nt, Artificial Sequence
  Marburg virus siRNA sense strand
gaaaucacgcgcacaaauuaa

SEQ ID NO: 38672 - RNA, 21 nt, Artificial Sequence
  Marburg virus siRNA sense strand
aaaucacgcgcacaaauuaac

SEQ ID NO: 38673 - RNA, 21 nt, Artificial Sequence
  Marburg virus siRNA sense strand
aaucacgcgcacaaauuaacu

SEQ ID NO: 38674 - RNA, 21 nt, Artificial Sequence
  Marburg virus siRNA sense strand
aucacgcgcacaaauuaacuu

SEQ ID NO: 38675 - RNA, 21 nt, Artificial Sequence
  Marburg virus siRNA sense strand
ucacgcgcacaaauuaacuug

SEQ ID NO: 38676 - RNA, 21 nt, Artificial Sequence
  Marburg virus siRNA sense strand
cacgcgcacaaauuaacuugu

SEQ ID NO: 38677 - RNA, 21 nt, Artificial Sequence
  Marburg virus siRNA sense strand
acgcgcacaaauuaacuugug

SEQ ID NO: 38678 - RNA, 21 nt, Artificial Sequence
  Marburg virus siRNA sense strand
cgcgcacaaauuaacuuguga

SEQ ID NO: 38679 - RNA, 21 nt, Artificial Sequence
  Marburg virus siRNA sense strand
gcgcacaaauuaacuugugau

SEQ ID NO: 38680 - RNA, 21 nt, Artificial Sequence
  Marburg virus siRNA sense strand
cgcacaaauuaacuugugauu

SEQ ID NO: 38681 - RNA, 21 nt, Artificial Sequence
  Marburg virus siRNA sense strand
gcacaaauuaacuugugauug

SEQ ID NO: 38682 - RNA, 21 nt, Artificial Sequence
  Marburg virus siRNA sense strand
cacaaauuaacuugugauuga

SEQ ID NO: 38683 - RNA, 21 nt, Artificial Sequence
  Marburg virus siRNA sense strand
acaaauuaacuugugauugaa

SEQ ID NO: 38684 - RNA, 21 nt, Artificial Sequence
  Marburg virus siRNA sense strand
caaauuaacuugugauugaac

SEQ ID NO: 38685 - RNA, 21 nt, Artificial Sequence
  Marburg virus siRNA sense strand
aaauuaacuugugauugaacg

SEQ ID NO: 38686 - RNA, 21 nt, Artificial Sequence
  Marburg virus siRNA sense strand
aauuaacuugugauugaacgu

SEQ ID NO: 38687 - RNA, 21 nt, Artificial Sequence
  Marburg virus siRNA sense strand
auuaacuugugauugaacguu

SEQ ID NO: 38688 - RNA, 21 nt, Artificial Sequence
  Marburg virus siRNA sense strand
uuaacuugugauugaacguuc

SEQ ID NO: 38689 - RNA, 21 nt, Artificial Sequence
  Marburg virus siRNA sense strand
uaacuugugauugaacguucg

SEQ ID NO: 38690 - RNA, 21 nt, Artificial Sequence
  Marburg virus siRNA sense strand
aacuugugauugaacguucgg

SEQ ID NO: 38691 - RNA, 21 nt, Artificial Sequence
  Marburg virus siRNA sense strand
acuugugauugaacguucggu

SEQ ID NO: 38692 - RNA, 21 nt, Artificial Sequence
  Marburg virus siRNA sense strand
cuugugauugaacguucgguc

SEQ ID NO: 38693 - RNA, 21 nt, Artificial Sequence
  Marburg virus siRNA sense strand
uugugauugaacguucgguca

SEQ ID NO: 38694 - RNA, 21 nt, Artificial Sequence
  Marburg virus siRNA sense strand
ugugauugaacguucggucac

SEQ ID NO: 38695 - RNA, 21 nt, Artificial Sequence
  Marburg virus siRNA sense strand
gugauugaacguucggucaca

SEQ ID NO: 38696 - RNA, 21 nt, Artificial Sequence
  Marburg virus siRNA sense strand
ugauugaacguucggucacac

SEQ ID NO: 38697 - RNA, 21 nt, Artificial Sequence
  Marburg virus siRNA sense strand
gauugaacguucggucacacc

SEQ ID NO: 38698 - RNA, 21 nt, Artificial Sequence
  Marburg virus siRNA sense strand
auugaacguucggucacacca

SEQ ID NO: 38699 - RNA, 21 nt, Artificial Sequence
  Marburg virus siRNA sense strand
uugaacguucggucacaccag

SEQ ID NO: 38700 - RNA, 21 nt, Artificial Sequence
  Marburg virus siRNA sense strand
ugaacguucggucacaccagu

SEQ ID NO: 38701 - RNA, 21 nt, Artificial Sequence
  Marburg virus siRNA sense strand
gaacguucggucacaccagug

SEQ ID NO: 38702 - RNA, 21 nt, Artificial Sequence
  Marburg virus siRNA sense strand
aacguucggucacaccagugg

SEQ ID NO: 38703 - RNA, 21 nt, Artificial Sequence
  Marburg virus siRNA sense strand
acguucggucacaccaguggu

SEQ ID NO: 38704 - RNA, 21 nt, Artificial Sequence
  Marburg virus siRNA sense strand
cguucggucacaccaguggua

SEQ ID NO: 38705 - RNA, 21 nt, Artificial Sequence
  Marburg virus siRNA sense strand
guucggucacaccagugguaa

SEQ ID NO: 38706 - RNA, 21 nt, Artificial Sequence
  Marburg virus siRNA sense strand
uucggucacaccagugguaac

SEQ ID NO: 38707 - RNA, 21 nt, Artificial Sequence
  Marburg virus siRNA sense strand
ucggucacaccagugguaacu

SEQ ID NO: 38708 - RNA, 21 nt, Artificial Sequence
  Marburg virus siRNA sense strand
cggucacaccagugguaacuu

SEQ ID NO: 38709 - RNA, 21 nt, Artificial Sequence
  Marburg virus siRNA sense strand
ggucacaccagugguaacuuu

SEQ ID NO: 38710 - RNA, 21 nt, Artificial Sequence
  Marburg virus siRNA sense strand
gucacaccagugguaacuuuu

SEQ ID NO: 38711 - RNA, 21 nt, Artificial Sequence
  Marburg virus siRNA sense strand
ucacaccagugguaacuuuuc

SEQ ID NO: 38712 - RNA, 21 nt, Artificial Sequence
  Marburg virus siRNA sense strand
cacaccagugguaacuuuuca

SEQ ID NO: 38713 - RNA, 21 nt, Artificial Sequence
  Marburg virus siRNA sense strand
acaccagugguaacuuuucaa

SEQ ID NO: 38714 - RNA, 21 nt, Artificial Sequence
  Marburg virus siRNA sense strand
caccagugguaacuuuucaau

SEQ ID NO: 38715 - RNA, 21 nt, Artificial Sequence
  Marburg virus siRNA sense strand
accagugguaacuuuucaaug

SEQ ID NO: 38716 - RNA, 21 nt, Artificial Sequence
  Marburg virus siRNA sense strand
ccagugguaacuuuucaaugu

SEQ ID NO: 38717 - RNA, 21 nt, Artificial Sequence
  Marburg virus siRNA sense strand
cagugguaacuuuucaauguu

SEQ ID NO: 38718 - RNA, 21 nt, Artificial Sequence
  Marburg virus siRNA sense strand
agugguaacuuuucaauguua

SEQ ID NO: 38719 - RNA, 21 nt, Artificial Sequence
  Marburg virus siRNA sense strand
gugguaacuuuucaauguuag

SEQ ID NO: 38720 - RNA, 21 nt, Artificial Sequence
  Marburg virus siRNA sense strand
ugguaacuuuucaauguuagu

SEQ ID NO: 38721 - RNA, 21 nt, Artificial Sequence
  Marburg virus siRNA sense strand
gguaacuuuucaauguuaguu

SEQ ID NO: 38722 - RNA, 21 nt, Artificial Sequence
  Marburg virus siRNA sense strand
guaacuuuucaauguuaguua

SEQ ID NO: 38723 - RNA, 21 nt, Artificial Sequence
  Marburg virus siRNA sense strand
uaacuuuucaauguuaguuac

SEQ ID NO: 38724 - RNA, 21 nt, Artificial Sequence
  Marburg virus siRNA sense strand
aacuuuucaauguuaguuacu

SEQ ID NO: 38725 - RNA, 21 nt, Artificial Sequence
  Marburg virus siRNA sense strand
acuuuucaauguuaguuacuc

SEQ ID NO: 38726 - RNA, 21 nt, Artificial Sequence
  Marburg virus siRNA sense strand
cuuuucaauguuaguuacuca

SEQ ID NO: 38727 - RNA, 21 nt, Artificial Sequence
  Marburg virus siRNA sense strand
uuuucaauguuaguuacucaa

SEQ ID NO: 38728 - RNA, 21 nt, Artificial Sequence
  Marburg virus siRNA sense strand
uuucaauguuaguuacucaaa

SEQ ID NO: 38729 - RNA, 21 nt, Artificial Sequence
  Marburg virus siRNA sense strand
uucaauguuaguuacucaaau

SEQ ID NO: 38730 - RNA, 21 nt, Artificial Sequence
  Marburg virus siRNA sense strand
ucaauguuaguuacucaaaua

SEQ ID NO: 38731 - RNA, 21 nt, Artificial Sequence
  Marburg virus siRNA sense strand
caauguuaguuacucaaauau

SEQ ID NO: 38732 - RNA, 21 nt, Artificial Sequence
  Marburg virus siRNA sense strand
aauguuaguuacucaaauauu

SEQ ID NO: 38733 - RNA, 21 nt, Artificial Sequence
  Marburg virus siRNA sense strand
auguuaguuacucaaauauua

SEQ ID NO: 38734 - RNA, 21 nt, Artificial Sequence
  Marburg virus siRNA sense strand
uguuaguuacucaaauauuau

SEQ ID NO: 38735 - RNA, 21 nt, Artificial Sequence
  Marburg virus siRNA sense strand
guuaguuacucaaauauuauu

SEQ ID NO: 38736 - RNA, 21 nt, Artificial Sequence
  Marburg virus siRNA sense strand
uuaguuacucaaauauuauug

SEQ ID NO: 38737 - RNA, 21 nt, Artificial Sequence
  Marburg virus siRNA sense strand
uaguuacucaaauauuauugc

SEQ ID NO: 38738 - RNA, 21 nt, Artificial Sequence
  Marburg virus siRNA sense strand
aguuacucaaauauuauugcu

SEQ ID NO: 38739 - RNA, 21 nt, Artificial Sequence
  Marburg virus siRNA sense strand
guuacucaaauauuauugcuc

SEQ ID NO: 38740 - RNA, 21 nt, Artificial Sequence
  Marburg virus siRNA sense strand
uuacucaaauauuauugcuca

SEQ ID NO: 38741 - RNA, 21 nt, Artificial Sequence
  Marburg virus siRNA sense strand
uacucaaauauuauugcucau

SEQ ID NO: 38742 - RNA, 21 nt, Artificial Sequence
  Marburg virus siRNA sense strand
acucaaauauuauugcucaua

SEQ ID NO: 38743 - RNA, 21 nt, Artificial Sequence
  Marburg virus siRNA sense strand
cucaaauauuauugcucauaa

SEQ ID NO: 38744 - RNA, 21 nt, Artificial Sequence
  Marburg virus siRNA sense strand
ucaaauauuauugcucauaau

SEQ ID NO: 38745 - RNA, 21 nt, Artificial Sequence
  Marburg virus siRNA sense strand
caaauauuauugcucauaauu

SEQ ID NO: 38746 - RNA, 21 nt, Artificial Sequence
  Marburg virus siRNA sense strand
aaauauuauugcucauaauug

SEQ ID NO: 38747 - RNA, 21 nt, Artificial Sequence
  Marburg virus siRNA sense strand
aauauuauugcucauaauugg

SEQ ID NO: 38748 - RNA, 21 nt, Artificial Sequence
  Marburg virus siRNA sense strand
auauuauugcucauaauuggu

SEQ ID NO: 38749 - RNA, 21 nt, Artificial Sequence
  Marburg virus siRNA sense strand
uauuauugcucauaauuggua

SEQ ID NO: 38750 - RNA, 21 nt, Artificial Sequence
  Marburg virus siRNA sense strand
auuauugcucauaauugguau

SEQ ID NO: 38751 - RNA, 21 nt, Artificial Sequence
  Marburg virus siRNA sense strand
uuauugcucauaauugguauu

SEQ ID NO: 38752 - RNA, 21 nt, Artificial Sequence
  Marburg virus siRNA sense strand
uauugcucauaauugguauug

SEQ ID NO: 38753 - RNA, 21 nt, Artificial Sequence
  Marburg virus siRNA sense strand
auugcucauaauugguauuga

SEQ ID NO: 38754 - RNA, 21 nt, Artificial Sequence
  Marburg virus siRNA sense strand
uugcucauaauugguauugau

SEQ ID NO: 38755 - RNA, 21 nt, Artificial Sequence
  Marburg virus siRNA sense strand
ugcucauaauugguauugaua

SEQ ID NO: 38756 - RNA, 21 nt, Artificial Sequence
  Marburg virus siRNA sense strand
gcucauaauugguauugauau

SEQ ID NO: 38757 - RNA, 21 nt, Artificial Sequence
  Marburg virus siRNA sense strand
cucauaauugguauugauauu

SEQ ID NO: 38758 - RNA, 21 nt, Artificial Sequence
  Marburg virus siRNA sense strand
ucauaauugguauugauauug

SEQ ID NO: 38759 - RNA, 21 nt, Artificial Sequence
  Marburg virus siRNA sense strand
cauaauugguauugauauugg

SEQ ID NO: 38760 - RNA, 21 nt, Artificial Sequence
  Marburg virus siRNA sense strand
auaauugguauugauauuggu

SEQ ID NO: 38761 - RNA, 21 nt, Artificial Sequence
  Marburg virus siRNA sense strand
uaauugguauugauauuggua

SEQ ID NO: 38762 - RNA, 21 nt, Artificial Sequence
  Marburg virus siRNA sense strand
aauugguauugauauugguac

SEQ ID NO: 38763 - RNA, 21 nt, Artificial Sequence
  Marburg virus siRNA sense strand
auugguauugauauugguaca

SEQ ID NO: 38764 - RNA, 21 nt, Artificial Sequence
  Marburg virus siRNA sense strand
uugguauugauauugguacau

SEQ ID NO: 38765 - RNA, 21 nt, Artificial Sequence
  Marburg virus siRNA sense strand
ugguauugauauugguacauu

SEQ ID NO: 38766 - RNA, 21 nt, Artificial Sequence
  Marburg virus siRNA sense strand
gguauugauauugguacauug

SEQ ID NO: 38767 - RNA, 21 nt, Artificial Sequence
  Marburg virus siRNA sense strand
guauugauauugguacauugg

SEQ ID NO: 38768 - RNA, 21 nt, Artificial Sequence
  Marburg virus siRNA sense strand
uauugauauugguacauuggg

SEQ ID NO: 38769 - RNA, 21 nt, Artificial Sequence
  Marburg virus siRNA sense strand
auugauauugguacauugggu

SEQ ID NO: 38770 - RNA, 21 nt, Artificial Sequence
  Marburg virus siRNA sense strand
uugauauugguacauugggug

SEQ ID NO: 38771 - RNA, 21 nt, Artificial Sequence
  Marburg virus siRNA sense strand
ugauauugguacauuggguga

SEQ ID NO: 38772 - RNA, 21 nt, Artificial Sequence
  Marburg virus siRNA sense strand
gauauugguacauugggugag

SEQ ID NO: 38773 - RNA, 21 nt, Artificial Sequence
  Marburg virus siRNA sense strand
auauugguacauugggugagu

SEQ ID NO: 38774 - RNA, 21 nt, Artificial Sequence
  Marburg virus siRNA sense strand
uauugguacauugggugaguc

SEQ ID NO: 38775 - RNA, 21 nt, Artificial Sequence
  Marburg virus siRNA sense strand
auugguacauugggugagucc

SEQ ID NO: 38776 - RNA, 21 nt, Artificial Sequence
  Marburg virus siRNA sense strand
uugguacauugggugaguccu

SEQ ID NO: 38777 - RNA, 21 nt, Artificial Sequence
  Marburg virus siRNA sense strand
ugguacauugggugaguccuu

SEQ ID NO: 38778 - RNA, 21 nt, Artificial Sequence
  Marburg virus siRNA sense strand
gguacauugggugaguccuug

SEQ ID NO: 38779 - RNA, 21 nt, Artificial Sequence
  Marburg virus siRNA sense strand
guacauugggugaguccuuga

SEQ ID NO: 38780 - RNA, 21 nt, Artificial Sequence
  Marburg virus siRNA sense strand
uacauugggugaguccuugag

SEQ ID NO: 38781 - RNA, 21 nt, Artificial Sequence
  Marburg virus siRNA sense strand
acauugggugaguccuugagc

SEQ ID NO: 38782 - RNA, 21 nt, Artificial Sequence
  Marburg virus siRNA sense strand
cauugggugaguccuugagcu

SEQ ID NO: 38783 - RNA, 21 nt, Artificial Sequence
  Marburg virus siRNA sense strand
auugggugaguccuugagcuu

SEQ ID NO: 38784 - RNA, 21 nt, Artificial Sequence
  Marburg virus siRNA sense strand
uugggugaguccuugagcuuu

SEQ ID NO: 38785 - RNA, 21 nt, Artificial Sequence
  Marburg virus siRNA sense strand
ugggugaguccuugagcuuua

SEQ ID NO: 38786 - RNA, 21 nt, Artificial Sequence
  Marburg virus siRNA sense strand
gggugaguccuugagcuuuau

SEQ ID NO: 38787 - RNA, 21 nt, Artificial Sequence
  Marburg virus siRNA sense strand
ggugaguccuugagcuuuauc

SEQ ID NO: 38788 - RNA, 21 nt, Artificial Sequence
  Marburg virus siRNA sense strand
gugaguccuugagcuuuaucc

SEQ ID NO: 38789 - RNA, 21 nt, Artificial Sequence
  Marburg virus siRNA sense strand
ugaguccuugagcuuuauccu

SEQ ID NO: 38790 - RNA, 21 nt, Artificial Sequence
  Marburg virus siRNA sense strand
gaguccuugagcuuuauccuu

SEQ ID NO: 38791 - RNA, 21 nt, Artificial Sequence
  Marburg virus siRNA sense strand
aguccuugagcuuuauccuua

SEQ ID NO: 38792 - RNA, 21 nt, Artificial Sequence
  Marburg virus siRNA sense strand
guccuugagcuuuauccuuaa

SEQ ID NO: 38793 - RNA, 21 nt, Artificial Sequence
  Marburg virus siRNA sense strand
uccuugagcuuuauccuuaau

SEQ ID NO: 38794 - RNA, 21 nt, Artificial Sequence
  Marburg virus siRNA sense strand
ccuugagcuuuauccuuaaua

SEQ ID NO: 38795 - RNA, 21 nt, Artificial Sequence
  Marburg virus siRNA sense strand
cuugagcuuuauccuuaauau

SEQ ID NO: 38796 - RNA, 21 nt, Artificial Sequence
  Marburg virus siRNA sense strand
uugagcuuuauccuuaauaua

SEQ ID NO: 38797 - RNA, 21 nt, Artificial Sequence
  Marburg virus siRNA sense strand
ugagcuuuauccuuaauauaa

SEQ ID NO: 38798 - RNA, 21 nt, Artificial Sequence
  Marburg virus siRNA sense strand
gagcuuuauccuuaauauaau

SEQ ID NO: 38799 - RNA, 21 nt, Artificial Sequence
  Marburg virus siRNA sense strand
agcuuuauccuuaauauaaug

SEQ ID NO: 38800 - RNA, 21 nt, Artificial Sequence
  Marburg virus siRNA sense strand
gcuuuauccuuaauauaaugu

SEQ ID NO: 38801 - RNA, 21 nt, Artificial Sequence
  Marburg virus siRNA sense strand
cuuuauccuuaauauaaugua

SEQ ID NO: 38802 - RNA, 21 nt, Artificial Sequence
  Marburg virus siRNA sense strand
uuuauccuuaauauaauguaa

SEQ ID NO: 38803 - RNA, 21 nt, Artificial Sequence
  Marburg virus siRNA sense strand
uuauccuuaauauaauguaag

SEQ ID NO: 38804 - RNA, 21 nt, Artificial Sequence
  Marburg virus siRNA sense strand
uauccuuaauauaauguaaga

SEQ ID NO: 38805 - RNA, 21 nt, Artificial Sequence
  Marburg virus siRNA sense strand
auccuuaauauaauguaagaa

SEQ ID NO: 38806 - RNA, 21 nt, Artificial Sequence
  Marburg virus siRNA sense strand
uccuuaauauaauguaagaaa

SEQ ID NO: 38807 - RNA, 21 nt, Artificial Sequence
  Marburg virus siRNA sense strand
ccuuaauauaauguaagaaau

SEQ ID NO: 38808 - RNA, 21 nt, Artificial Sequence
  Marburg virus siRNA sense strand
cuuaauauaauguaagaaauu

SEQ ID NO: 38809 - RNA, 21 nt, Artificial Sequence
  Marburg virus siRNA sense strand
uuaauauaauguaagaaauua

SEQ ID NO: 38810 - RNA, 21 nt, Artificial Sequence
  Marburg virus siRNA sense strand
uaauauaauguaagaaauuag

SEQ ID NO: 38811 - RNA, 21 nt, Artificial Sequence
  Marburg virus siRNA sense strand
aauauaauguaagaaauuagg

SEQ ID NO: 38812 - RNA, 21 nt, Artificial Sequence
  Marburg virus siRNA sense strand
auauaauguaagaaauuaggg

SEQ ID NO: 38813 - RNA, 21 nt, Artificial Sequence
  Marburg virus siRNA sense strand
uauaauguaagaaauuaggga

SEQ ID NO: 38814 - RNA, 21 nt, Artificial Sequence
  Marburg virus siRNA sense strand
auaauguaagaaauuagggaa

SEQ ID NO: 38815 - RNA, 21 nt, Artificial Sequence
  Marburg virus siRNA sense strand
uaauguaagaaauuagggaaa

SEQ ID NO: 38816 - RNA, 21 nt, Artificial Sequence
  Marburg virus siRNA sense strand
aauguaagaaauuagggaaau

SEQ ID NO: 38817 - RNA, 21 nt, Artificial Sequence
  Marburg virus siRNA sense strand
auguaagaaauuagggaaaua

SEQ ID NO: 38818 - RNA, 21 nt, Artificial Sequence
  Marburg virus siRNA sense strand
uguaagaaauuagggaaauac

SEQ ID NO: 38819 - RNA, 21 nt, Artificial Sequence
  Marburg virus siRNA sense strand
guaagaaauuagggaaauacu

SEQ ID NO: 38820 - RNA, 21 nt, Artificial Sequence
  Marburg virus siRNA sense strand
uaagaaauuagggaaauacug

SEQ ID NO: 38821 - RNA, 21 nt, Artificial Sequence
  Marburg virus siRNA sense strand
aagaaauuagggaaauacuga

SEQ ID NO: 38822 - RNA, 21 nt, Artificial Sequence
  Marburg virus siRNA sense strand
agaaauuagggaaauacugag

SEQ ID NO: 38823 - RNA, 21 nt, Artificial Sequence
  Marburg virus siRNA sense strand
gaaauuagggaaauacugaga

SEQ ID NO: 38824 - RNA, 21 nt, Artificial Sequence
  Marburg virus siRNA sense strand
aaauuagggaaauacugagau

SEQ ID NO: 38825 - RNA, 21 nt, Artificial Sequence
  Marburg virus siRNA sense strand
aauuagggaaauacugagaua

SEQ ID NO: 38826 - RNA, 21 nt, Artificial Sequence
  Marburg virus siRNA sense strand
auuagggaaauacugagauau

SEQ ID NO: 38827 - RNA, 21 nt, Artificial Sequence
  Marburg virus siRNA sense strand
uuagggaaauacugagauaua

SEQ ID NO: 38828 - RNA, 21 nt, Artificial Sequence
  Marburg virus siRNA sense strand
uagggaaauacugagauauac

SEQ ID NO: 38829 - RNA, 21 nt, Artificial Sequence
  Marburg virus siRNA sense strand
agggaaauacugagauauacu

SEQ ID NO: 38830 - RNA, 21 nt, Artificial Sequence
  Marburg virus siRNA sense strand
gggaaauacugagauauacua

SEQ ID NO: 38831 - RNA, 21 nt, Artificial Sequence
  Marburg virus siRNA sense strand
ggaaauacugagauauacuag

SEQ ID NO: 38832 - RNA, 21 nt, Artificial Sequence
  Marburg virus siRNA sense strand
gaaauacugagauauacuagu

SEQ ID NO: 38833 - RNA, 21 nt, Artificial Sequence
  Marburg virus siRNA sense strand
aaauacugagauauacuaguu

SEQ ID NO: 38834 - RNA, 21 nt, Artificial Sequence
  Marburg virus siRNA sense strand
aauacugagauauacuaguug

SEQ ID NO: 38835 - RNA, 21 nt, Artificial Sequence
  Marburg virus siRNA sense strand
auacugagauauacuaguuga

SEQ ID NO: 38836 - RNA, 21 nt, Artificial Sequence
  Marburg virus siRNA sense strand
uacugagauauacuaguugaa

SEQ ID NO: 38837 - RNA, 21 nt, Artificial Sequence
  Marburg virus siRNA sense strand
acugagauauacuaguugaau

SEQ ID NO: 38838 - RNA, 21 nt, Artificial Sequence
  Marburg virus siRNA sense strand
cugagauauacuaguugaauu

SEQ ID NO: 38839 - RNA, 21 nt, Artificial Sequence
  Marburg virus siRNA sense strand
ugagauauacuaguugaauug

SEQ ID NO: 38840 - RNA, 21 nt, Artificial Sequence
  Marburg virus siRNA sense strand
gagauauacuaguugaauuga

SEQ ID NO: 38841 - RNA, 21 nt, Artificial Sequence
  Marburg virus siRNA sense strand
agauauacuaguugaauugag

SEQ ID NO: 38842 - RNA, 21 nt, Artificial Sequence
  Marburg virus siRNA sense strand
gauauacuaguugaauugagu

SEQ ID NO: 38843 - RNA, 21 nt, Artificial Sequence
  Marburg virus siRNA sense strand
auauacuaguugaauugaguu

SEQ ID NO: 38844 - RNA, 21 nt, Artificial Sequence
  Marburg virus siRNA sense strand
uauacuaguugaauugaguua

SEQ ID NO: 38845 - RNA, 21 nt, Artificial Sequence
  Marburg virus siRNA sense strand
auacuaguugaauugaguuau

SEQ ID NO: 38846 - RNA, 21 nt, Artificial Sequence
  Marburg virus siRNA sense strand
uacuaguugaauugaguuaug

SEQ ID NO: 38847 - RNA, 21 nt, Artificial Sequence
  Marburg virus siRNA sense strand
acuaguugaauugaguuauga

SEQ ID NO: 38848 - RNA, 21 nt, Artificial Sequence
  Marburg virus siRNA sense strand
cuaguugaauugaguuaugac

SEQ ID NO: 38849 - RNA, 21 nt, Artificial Sequence
  Marburg virus siRNA sense strand
uaguugaauugaguuaugaca

SEQ ID NO: 38850 - RNA, 21 nt, Artificial Sequence
  Marburg virus siRNA sense strand
aguugaauugaguuaugacau

SEQ ID NO: 38851 - RNA, 21 nt, Artificial Sequence
  Marburg virus siRNA sense strand
guugaauugaguuaugacaua

SEQ ID NO: 38852 - RNA, 21 nt, Artificial Sequence
  Marburg virus siRNA sense strand
uugaauugaguuaugacauac

SEQ ID NO: 38853 - RNA, 21 nt, Artificial Sequence
  Marburg virus siRNA sense strand
ugaauugaguuaugacauacc

SEQ ID NO: 38854 - RNA, 21 nt, Artificial Sequence
  Marburg virus siRNA sense strand
gaauugaguuaugacauacca

SEQ ID NO: 38855 - RNA, 21 nt, Artificial Sequence
  Marburg virus siRNA sense strand
aauugaguuaugacauaccau

SEQ ID NO: 38856 - RNA, 21 nt, Artificial Sequence
  Marburg virus siRNA sense strand
auugaguuaugacauaccaua

SEQ ID NO: 38857 - RNA, 21 nt, Artificial Sequence
  Marburg virus siRNA sense strand
uugaguuaugacauaccauau

SEQ ID NO: 38858 - RNA, 21 nt, Artificial Sequence
  Marburg virus siRNA sense strand
ugaguuaugacauaccauaua

SEQ ID NO: 38859 - RNA, 21 nt, Artificial Sequence
  Marburg virus siRNA sense strand
gaguuaugacauaccauauau

SEQ ID NO: 38860 - RNA, 21 nt, Artificial Sequence
  Marburg virus siRNA sense strand
aguuaugacauaccauauauc

SEQ ID NO: 38861 - RNA, 21 nt, Artificial Sequence
  Marburg virus siRNA sense strand
guuaugacauaccauauauca

SEQ ID NO: 38862 - RNA, 21 nt, Artificial Sequence
  Marburg virus siRNA sense strand
uuaugacauaccauauaucau

SEQ ID NO: 38863 - RNA, 21 nt, Artificial Sequence
  Marburg virus siRNA sense strand
uaugacauaccauauaucaua

SEQ ID NO: 38864 - RNA, 21 nt, Artificial Sequence
  Marburg virus siRNA sense strand
augacauaccauauaucauaa

SEQ ID NO: 38865 - RNA, 21 nt, Artificial Sequence
  Marburg virus siRNA sense strand
ugacauaccauauaucauaaa

SEQ ID NO: 38866 - RNA, 21 nt, Artificial Sequence
  Marburg virus siRNA sense strand
gacauaccauauaucauaaau

SEQ ID NO: 38867 - RNA, 21 nt, Artificial Sequence
  Marburg virus siRNA sense strand
acauaccauauaucauaaaua

SEQ ID NO: 38868 - RNA, 21 nt, Artificial Sequence
  Marburg virus siRNA sense strand
cauaccauauaucauaaauau

SEQ ID NO: 38869 - RNA, 21 nt, Artificial Sequence
  Marburg virus siRNA sense strand
auaccauauaucauaaauaua

SEQ ID NO: 38870 - RNA, 21 nt, Artificial Sequence
  Marburg virus siRNA sense strand
uaccauauaucauaaauauaa

SEQ ID NO: 38871 - RNA, 21 nt, Artificial Sequence
  Marburg virus siRNA sense strand
accauauaucauaaauauaaa

SEQ ID NO: 38872 - RNA, 21 nt, Artificial Sequence
  Marburg virus siRNA sense strand
ccauauaucauaaauauaaaa

SEQ ID NO: 38873 - RNA, 21 nt, Artificial Sequence
  Marburg virus siRNA sense strand
cauauaucauaaauauaaaag

SEQ ID NO: 38874 - RNA, 21 nt, Artificial Sequence
  Marburg virus siRNA sense strand
auauaucauaaauauaaaaga

SEQ ID NO: 38875 - RNA, 21 nt, Artificial Sequence
  Marburg virus siRNA sense strand
uauaucauaaauauaaaagaa

SEQ ID NO: 38876 - RNA, 21 nt, Artificial Sequence
  Marburg virus siRNA sense strand
auaucauaaauauaaaagaac

SEQ ID NO: 38877 - RNA, 21 nt, Artificial Sequence
  Marburg virus siRNA sense strand
uaucauaaauauaaaagaacg

SEQ ID NO: 38878 - RNA, 21 nt, Artificial Sequence
  Marburg virus siRNA sense strand
aucauaaauauaaaagaacga

SEQ ID NO: 38879 - RNA, 21 nt, Artificial Sequence
  Marburg virus siRNA sense strand
ucauaaauauaaaagaacgau

SEQ ID NO: 38880 - RNA, 21 nt, Artificial Sequence
  Marburg virus siRNA sense strand
cauaaauauaaaagaacgauc

SEQ ID NO: 38881 - RNA, 21 nt, Artificial Sequence
  Marburg virus siRNA sense strand
auaaauauaaaagaacgaucu

SEQ ID NO: 38882 - RNA, 21 nt, Artificial Sequence
  Marburg virus siRNA sense strand
uaaauauaaaagaacgaucug

SEQ ID NO: 38883 - RNA, 21 nt, Artificial Sequence
  Marburg virus siRNA sense strand
aaauauaaaagaacgaucugc

SEQ ID NO: 38884 - RNA, 21 nt, Artificial Sequence
  Marburg virus siRNA sense strand
aauauaaaagaacgaucugcu

SEQ ID NO: 38885 - RNA, 21 nt, Artificial Sequence
  Marburg virus siRNA sense strand
auauaaaagaacgaucugcug

SEQ ID NO: 38886 - RNA, 21 nt, Artificial Sequence
  Marburg virus siRNA sense strand
uauaaaagaacgaucugcugu

SEQ ID NO: 38887 - RNA, 21 nt, Artificial Sequence
  Marburg virus siRNA sense strand
auaaaagaacgaucugcugua

SEQ ID NO: 38888 - RNA, 21 nt, Artificial Sequence
  Marburg virus siRNA sense strand
uaaaagaacgaucugcuguaa

SEQ ID NO: 38889 - RNA, 21 nt, Artificial Sequence
  Marburg virus siRNA sense strand
aaaagaacgaucugcuguaau

SEQ ID NO: 38890 - RNA, 21 nt, Artificial Sequence
  Marburg virus siRNA sense strand
aaagaacgaucugcuguaauc

SEQ ID NO: 38891 - RNA, 21 nt, Artificial Sequence
  Marburg virus siRNA sense strand
aagaacgaucugcuguaaucu

SEQ ID NO: 38892 - RNA, 21 nt, Artificial Sequence
  Marburg virus siRNA sense strand
agaacgaucugcuguaaucua

SEQ ID NO: 38893 - RNA, 21 nt, Artificial Sequence
  Marburg virus siRNA sense strand
gaacgaucugcuguaaucuau

SEQ ID NO: 38894 - RNA, 21 nt, Artificial Sequence
  Marburg virus siRNA sense strand
aacgaucugcuguaaucuaua

SEQ ID NO: 38895 - RNA, 21 nt, Artificial Sequence
  Marburg virus siRNA sense strand
acgaucugcuguaaucuauaa

SEQ ID NO: 38896 - RNA, 21 nt, Artificial Sequence
  Marburg virus siRNA sense strand
cgaucugcuguaaucuauaag

SEQ ID NO: 38897 - RNA, 21 nt, Artificial Sequence
  Marburg virus siRNA sense strand
gaucugcuguaaucuauaagc

SEQ ID NO: 38898 - RNA, 21 nt, Artificial Sequence
  Marburg virus siRNA sense strand
aucugcuguaaucuauaagca

SEQ ID NO: 38899 - RNA, 21 nt, Artificial Sequence
  Marburg virus siRNA sense strand
ucugcuguaaucuauaagcau

SEQ ID NO: 38900 - RNA, 21 nt, Artificial Sequence
  Marburg virus siRNA sense strand
cugcuguaaucuauaagcauc

SEQ ID NO: 38901 - RNA, 21 nt, Artificial Sequence
  Marburg virus siRNA sense strand
ugcuguaaucuauaagcaucu

SEQ ID NO: 38902 - RNA, 21 nt, Artificial Sequence
  Marburg virus siRNA sense strand
gcuguaaucuauaagcaucuc

SEQ ID NO: 38903 - RNA, 21 nt, Artificial Sequence
  Marburg virus siRNA sense strand
cuguaaucuauaagcaucucu

SEQ ID NO: 38904 - RNA, 21 nt, Artificial Sequence
  Marburg virus siRNA sense strand
uguaaucuauaagcaucucuu

SEQ ID NO: 38905 - RNA, 21 nt, Artificial Sequence
  Marburg virus siRNA sense strand
guaaucuauaagcaucucuuu

SEQ ID NO: 38906 - RNA, 21 nt, Artificial Sequence
  Marburg virus siRNA sense strand
uaaucuauaagcaucucuuuu

SEQ ID NO: 38907 - RNA, 21 nt, Artificial Sequence
  Marburg virus siRNA sense strand
aaucuauaagcaucucuuuua

SEQ ID NO: 38908 - RNA, 21 nt, Artificial Sequence
  Marburg virus siRNA sense strand
aucuauaagcaucucuuuuac

SEQ ID NO: 38909 - RNA, 21 nt, Artificial Sequence
  Marburg virus siRNA sense strand
ucuauaagcaucucuuuuaca

SEQ ID NO: 38910 - RNA, 21 nt, Artificial Sequence
  Marburg virus siRNA sense strand
cuauaagcaucucuuuuacau

SEQ ID NO: 38911 - RNA, 21 nt, Artificial Sequence
  Marburg virus siRNA sense strand
uauaagcaucucuuuuacaua

SEQ ID NO: 38912 - RNA, 21 nt, Artificial Sequence
  Marburg virus siRNA sense strand
auaagcaucucuuuuacauac

SEQ ID NO: 38913 - RNA, 21 nt, Artificial Sequence
  Marburg virus siRNA sense strand
uaagcaucucuuuuacauaca

SEQ ID NO: 38914 - RNA, 21 nt, Artificial Sequence
  Marburg virus siRNA sense strand
aagcaucucuuuuacauacau

SEQ ID NO: 38915 - RNA, 21 nt, Artificial Sequence
  Marburg virus siRNA sense strand
agcaucucuuuuacauacauu

SEQ ID NO: 38916 - RNA, 21 nt, Artificial Sequence
  Marburg virus siRNA sense strand
gcaucucuuuuacauacauug

SEQ ID NO: 38917 - RNA, 21 nt, Artificial Sequence
  Marburg virus siRNA sense strand
caucucuuuuacauacauugg

SEQ ID NO: 38918 - RNA, 21 nt, Artificial Sequence
  Marburg virus siRNA sense strand
aucucuuuuacauacauuggg

SEQ ID NO: 38919 - RNA, 21 nt, Artificial Sequence
  Marburg virus siRNA sense strand
ucucuuuuacauacauugggg

SEQ ID NO: 38920 - RNA, 21 nt, Artificial Sequence
  Marburg virus siRNA sense strand
cucuuuuacauacauugggga

SEQ ID NO: 38921 - RNA, 21 nt, Artificial Sequence
  Marburg virus siRNA sense strand
ucuuuuacauacauuggggaa

SEQ ID NO: 38922 - RNA, 21 nt, Artificial Sequence
  Marburg virus siRNA sense strand
cuuuuacauacauuggggaaa

SEQ ID NO: 38923 - RNA, 21 nt, Artificial Sequence
  Marburg virus siRNA sense strand
uuuuacauacauuggggaaag

SEQ ID NO: 38924 - RNA, 21 nt, Artificial Sequence
  Marburg virus siRNA sense strand
uuuacauacauuggggaaaga

SEQ ID NO: 38925 - RNA, 21 nt, Artificial Sequence
  Marburg virus siRNA sense strand
uuacauacauuggggaaagaa

SEQ ID NO: 38926 - RNA, 21 nt, Artificial Sequence
  Marburg virus siRNA sense strand
uacauacauuggggaaagaac

SEQ ID NO: 38927 - RNA, 21 nt, Artificial Sequence
  Marburg virus siRNA sense strand
acauacauuggggaaagaacu

SEQ ID NO: 38928 - RNA, 21 nt, Artificial Sequence
  Marburg virus siRNA sense strand
cauacauuggggaaagaacua

SEQ ID NO: 38929 - RNA, 21 nt, Artificial Sequence
  Marburg virus siRNA sense strand
auacauuggggaaagaacuag

SEQ ID NO: 38930 - RNA, 21 nt, Artificial Sequence
  Marburg virus siRNA sense strand
uacauuggggaaagaacuagg

SEQ ID NO: 38931 - RNA, 21 nt, Artificial Sequence
  Marburg virus siRNA sense strand
acauuggggaaagaacuaggu

SEQ ID NO: 38932 - RNA, 21 nt, Artificial Sequence
  Marburg virus siRNA sense strand
cauuggggaaagaacuagguu

SEQ ID NO: 38933 - RNA, 21 nt, Artificial Sequence
  Marburg virus siRNA sense strand
auuggggaaagaacuagguua

SEQ ID NO: 38934 - RNA, 21 nt, Artificial Sequence
  Marburg virus siRNA sense strand
uuggggaaagaacuagguuau

SEQ ID NO: 38935 - RNA, 21 nt, Artificial Sequence
  Marburg virus siRNA sense strand
uggggaaagaacuagguuauc

SEQ ID NO: 38936 - RNA, 21 nt, Artificial Sequence
  Marburg virus siRNA sense strand
ggggaaagaacuagguuaucg

SEQ ID NO: 38937 - RNA, 21 nt, Artificial Sequence
  Marburg virus siRNA sense strand
gggaaagaacuagguuaucgu

SEQ ID NO: 38938 - RNA, 21 nt, Artificial Sequence
  Marburg virus siRNA sense strand
ggaaagaacuagguuaucguu

SEQ ID NO: 38939 - RNA, 21 nt, Artificial Sequence
  Marburg virus siRNA sense strand
gaaagaacuagguuaucguug

SEQ ID NO: 38940 - RNA, 21 nt, Artificial Sequence
  Marburg virus siRNA sense strand
aaagaacuagguuaucguuga

SEQ ID NO: 38941 - RNA, 21 nt, Artificial Sequence
  Marburg virus siRNA sense strand
aagaacuagguuaucguugag

SEQ ID NO: 38942 - RNA, 21 nt, Artificial Sequence
  Marburg virus siRNA sense strand
agaacuagguuaucguugaga

SEQ ID NO: 38943 - RNA, 21 nt, Artificial Sequence
  Marburg virus siRNA sense strand
gaacuagguuaucguugagau

SEQ ID NO: 38944 - RNA, 21 nt, Artificial Sequence
  Marburg virus siRNA sense strand
aacuagguuaucguugagauu

SEQ ID NO: 38945 - RNA, 21 nt, Artificial Sequence
  Marburg virus siRNA sense strand
acuagguuaucguugagauua

SEQ ID NO: 38946 - RNA, 21 nt, Artificial Sequence
  Marburg virus siRNA sense strand
cuagguuaucguugagauuaa

SEQ ID NO: 38947 - RNA, 21 nt, Artificial Sequence
  Marburg virus siRNA sense strand
uagguuaucguugagauuaaa

SEQ ID NO: 38948 - RNA, 21 nt, Artificial Sequence
  Marburg virus siRNA sense strand
agguuaucguugagauuaaaa

SEQ ID NO: 38949 - RNA, 21 nt, Artificial Sequence
  Marburg virus siRNA sense strand
gguuaucguugagauuaaaaa

SEQ ID NO: 38950 - RNA, 21 nt, Artificial Sequence
  Marburg virus siRNA sense strand
guuaucguugagauuaaaaag

SEQ ID NO: 38951 - RNA, 21 nt, Artificial Sequence
  Marburg virus siRNA sense strand
uuaucguugagauuaaaaaga

SEQ ID NO: 38952 - RNA, 21 nt, Artificial Sequence
  Marburg virus siRNA sense strand
uaucguugagauuaaaaagac

SEQ ID NO: 38953 - RNA, 21 nt, Artificial Sequence
  Marburg virus siRNA sense strand
aucguugagauuaaaaagacu

SEQ ID NO: 38954 - RNA, 21 nt, Artificial Sequence
  Marburg virus siRNA sense strand
ucguugagauuaaaaagacua

SEQ ID NO: 38955 - RNA, 21 nt, Artificial Sequence
  Marburg virus siRNA sense strand
cguugagauuaaaaagacuac

SEQ ID NO: 38956 - RNA, 21 nt, Artificial Sequence
  Marburg virus siRNA sense strand
guugagauuaaaaagacuacg

SEQ ID NO: 38957 - RNA, 21 nt, Artificial Sequence
  Marburg virus siRNA sense strand
uugagauuaaaaagacuacgu

SEQ ID NO: 38958 - RNA, 21 nt, Artificial Sequence
  Marburg virus siRNA sense strand
ugagauuaaaaagacuacguu

SEQ ID NO: 38959 - RNA, 21 nt, Artificial Sequence
  Marburg virus siRNA sense strand
gagauuaaaaagacuacguua

SEQ ID NO: 38960 - RNA, 21 nt, Artificial Sequence
  Marburg virus siRNA sense strand
agauuaaaaagacuacguuac

SEQ ID NO: 38961 - RNA, 21 nt, Artificial Sequence
  Marburg virus siRNA sense strand
gauuaaaaagacuacguuacg

SEQ ID NO: 38962 - RNA, 21 nt, Artificial Sequence
  Marburg virus siRNA sense strand
auuaaaaagacuacguuacgu

SEQ ID NO: 38963 - RNA, 21 nt, Artificial Sequence
  Marburg virus siRNA sense strand
uuaaaaagacuacguuacguu

SEQ ID NO: 38964 - RNA, 21 nt, Artificial Sequence
  Marburg virus siRNA sense strand
uaaaaagacuacguuacguuu

SEQ ID NO: 38965 - RNA, 21 nt, Artificial Sequence
  Marburg virus siRNA sense strand
aaaaagacuacguuacguuuu

SEQ ID NO: 38966 - RNA, 21 nt, Artificial Sequence
  Marburg virus siRNA sense strand
aaaagacuacguuacguuuuc

SEQ ID NO: 38967 - RNA, 21 nt, Artificial Sequence
  Marburg virus siRNA sense strand
aaagacuacguuacguuuucu

SEQ ID NO: 38968 - RNA, 21 nt, Artificial Sequence
  Marburg virus siRNA sense strand
aagacuacguuacguuuucuc

SEQ ID NO: 38969 - RNA, 21 nt, Artificial Sequence
  Marburg virus siRNA sense strand
agacuacguuacguuuucucu

SEQ ID NO: 38970 - RNA, 21 nt, Artificial Sequence
  Marburg virus siRNA sense strand
gacuacguuacguuuucucug

SEQ ID NO: 38971 - RNA, 21 nt, Artificial Sequence
  Marburg virus siRNA sense strand
acuacguuacguuuucucuga

SEQ ID NO: 38972 - RNA, 21 nt, Artificial Sequence
  Marburg virus siRNA sense strand
cuacguuacguuuucucugau

SEQ ID NO: 38973 - RNA, 21 nt, Artificial Sequence
  Marburg virus siRNA sense strand
uacguuacguuuucucugaug

SEQ ID NO: 38974 - RNA, 21 nt, Artificial Sequence
  Marburg virus siRNA sense strand
acguuacguuuucucugauga

SEQ ID NO: 38975 - RNA, 21 nt, Artificial Sequence
  Marburg virus siRNA sense strand
cguuacguuuucucugaugac

SEQ ID NO: 38976 - RNA, 21 nt, Artificial Sequence
  Marburg virus siRNA sense strand
guuacguuuucucugaugaca

SEQ ID NO: 38977 - RNA, 21 nt, Artificial Sequence
  Marburg virus siRNA sense strand
uuacguuuucucugaugacaa

SEQ ID NO: 38978 - RNA, 21 nt, Artificial Sequence
  Marburg virus siRNA sense strand
uacguuuucucugaugacaag

SEQ ID NO: 38979 - RNA, 21 nt, Artificial Sequence
  Marburg virus siRNA sense strand
acguuuucucugaugacaagu

SEQ ID NO: 38980 - RNA, 21 nt, Artificial Sequence
  Marburg virus siRNA sense strand
cguuuucucugaugacaagug

SEQ ID NO: 38981 - RNA, 21 nt, Artificial Sequence
  Marburg virus siRNA sense strand
guuuucucugaugacaaguga

SEQ ID NO: 38982 - RNA, 21 nt, Artificial Sequence
  Marburg virus siRNA sense strand
uuuucucugaugacaagugac

SEQ ID NO: 38983 - RNA, 21 nt, Artificial Sequence
  Marburg virus siRNA sense strand
uuucucugaugacaagugaca

SEQ ID NO: 38984 - RNA, 21 nt, Artificial Sequence
  Marburg virus siRNA sense strand
uucucugaugacaagugacaa

SEQ ID NO: 38985 - RNA, 21 nt, Artificial Sequence
  Marburg virus siRNA sense strand
ucucugaugacaagugacaaa

SEQ ID NO: 38986 - RNA, 21 nt, Artificial Sequence
  Marburg virus siRNA sense strand
cucugaugacaagugacaaaa

SEQ ID NO: 38987 - RNA, 21 nt, Artificial Sequence
  Marburg virus siRNA sense strand
ucugaugacaagugacaaaau

SEQ ID NO: 38988 - RNA, 21 nt, Artificial Sequence
  Marburg virus siRNA sense strand
cugaugacaagugacaaaauu

SEQ ID NO: 38989 - RNA, 21 nt, Artificial Sequence
  Marburg virus siRNA sense strand
ugaugacaagugacaaaauuu

SEQ ID NO: 38990 - RNA, 21 nt, Artificial Sequence
  Marburg virus siRNA sense strand
gaugacaagugacaaaauuuc

SEQ ID NO: 38991 - RNA, 21 nt, Artificial Sequence
  Marburg virus siRNA sense strand
augacaagugacaaaauuucg

SEQ ID NO: 38992 - RNA, 21 nt, Artificial Sequence
  Marburg virus siRNA sense strand
ugacaagugacaaaauuucgu

SEQ ID NO: 38993 - RNA, 21 nt, Artificial Sequence
  Marburg virus siRNA sense strand
gacaagugacaaaauuucgua

SEQ ID NO: 38994 - RNA, 21 nt, Artificial Sequence
  Marburg virus siRNA sense strand
acaagugacaaaauuucguag

SEQ ID NO: 38995 - RNA, 21 nt, Artificial Sequence
  Marburg virus siRNA sense strand
caagugacaaaauuucguagu

SEQ ID NO: 38996 - RNA, 21 nt, Artificial Sequence
  Marburg virus siRNA sense strand
aagugacaaaauuucguaguu

SEQ ID NO: 38997 - RNA, 21 nt, Artificial Sequence
  Marburg virus siRNA sense strand
agugacaaaauuucguaguua

SEQ ID NO: 38998 - RNA, 21 nt, Artificial Sequence
  Marburg virus siRNA sense strand
gugacaaaauuucguaguuaa

SEQ ID NO: 38999 - RNA, 21 nt, Artificial Sequence
  Marburg virus siRNA sense strand
ugacaaaauuucguaguuaaa

SEQ ID NO: 39000 - RNA, 21 nt, Artificial Sequence
  Marburg virus siRNA sense strand
gacaaaauuucguaguuaaau

SEQ ID NO: 39001 - RNA, 21 nt, Artificial Sequence
  Marburg virus siRNA sense strand
acaaaauuucguaguuaaauu

SEQ ID NO: 39002 - RNA, 21 nt, Artificial Sequence
  Marburg virus siRNA sense strand
caaaauuucguaguuaaauuu

SEQ ID NO: 39003 - RNA, 21 nt, Artificial Sequence
  Marburg virus siRNA sense strand
aaaauuucguaguuaaauuuc

SEQ ID NO: 39004 - RNA, 21 nt, Artificial Sequence
  Marburg virus siRNA sense strand
aaauuucguaguuaaauuucu

SEQ ID NO: 39005 - RNA, 21 nt, Artificial Sequence
  Marburg virus siRNA sense strand
aauuucguaguuaaauuucua

SEQ ID NO: 39006 - RNA, 21 nt, Artificial Sequence
  Marburg virus siRNA sense strand
auuucguaguuaaauuucuag

SEQ ID NO: 39007 - RNA, 21 nt, Artificial Sequence
  Marburg virus siRNA sense strand
uuucguaguuaaauuucuaga

SEQ ID NO: 39008 - RNA, 21 nt, Artificial Sequence
  Marburg virus siRNA sense strand
uucguaguuaaauuucuagaa

SEQ ID NO: 39009 - RNA, 21 nt, Artificial Sequence
  Marburg virus siRNA sense strand
ucguaguuaaauuucuagaau

SEQ ID NO: 39010 - RNA, 21 nt, Artificial Sequence
  Marburg virus siRNA sense strand
cguaguuaaauuucuagaaug

SEQ ID NO: 39011 - RNA, 21 nt, Artificial Sequence
  Marburg virus siRNA sense strand
guaguuaaauuucuagaaugu

SEQ ID NO: 39012 - RNA, 21 nt, Artificial Sequence
  Marburg virus siRNA sense strand
uaguuaaauuucuagaauguc

SEQ ID NO: 39013 - RNA, 21 nt, Artificial Sequence
  Marburg virus siRNA sense strand
aguuaaauuucuagaauguca

SEQ ID NO: 39014 - RNA, 21 nt, Artificial Sequence
  Marburg virus siRNA sense strand
guuaaauuucuagaaugucaa

SEQ ID NO: 39015 - RNA, 21 nt, Artificial Sequence
  Marburg virus siRNA sense strand
uuaaauuucuagaaugucaau

SEQ ID NO: 39016 - RNA, 21 nt, Artificial Sequence
  Marburg virus siRNA sense strand
uaaauuucuagaaugucaaug

SEQ ID NO: 39017 - RNA, 21 nt, Artificial Sequence
  Marburg virus siRNA sense strand
aaauuucuagaaugucaaugu

SEQ ID NO: 39018 - RNA, 21 nt, Artificial Sequence
  Marburg virus siRNA sense strand
aauuucuagaaugucaaugug

SEQ ID NO: 39019 - RNA, 21 nt, Artificial Sequence
  Marburg virus siRNA sense strand
auuucuagaaugucaauguga

SEQ ID NO: 39020 - RNA, 21 nt, Artificial Sequence
  Marburg virus siRNA sense strand
uuucuagaaugucaaugugaa

SEQ ID NO: 39021 - RNA, 21 nt, Artificial Sequence
  Marburg virus siRNA sense strand
uucuagaaugucaaugugaau

SEQ ID NO: 39022 - RNA, 21 nt, Artificial Sequence
  Marburg virus siRNA sense strand
ucuagaaugucaaugugaaug

SEQ ID NO: 39023 - RNA, 21 nt, Artificial Sequence
  Marburg virus siRNA sense strand
cuagaaugucaaugugaaugu

SEQ ID NO: 39024 - RNA, 21 nt, Artificial Sequence
  Marburg virus siRNA sense strand
uagaaugucaaugugaaugua

SEQ ID NO: 39025 - RNA, 21 nt, Artificial Sequence
  Marburg virus siRNA sense strand
agaaugucaaugugaauguaa

SEQ ID NO: 39026 - RNA, 21 nt, Artificial Sequence
  Marburg virus siRNA sense strand
gaaugucaaugugaauguaaa

SEQ ID NO: 39027 - RNA, 21 nt, Artificial Sequence
  Marburg virus siRNA sense strand
aaugucaaugugaauguaaau

SEQ ID NO: 39028 - RNA, 21 nt, Artificial Sequence
  Marburg virus siRNA sense strand
augucaaugugaauguaaauu

SEQ ID NO: 39029 - RNA, 21 nt, Artificial Sequence
  Marburg virus siRNA sense strand
ugucaaugugaauguaaauua

SEQ ID NO: 39030 - RNA, 21 nt, Artificial Sequence
  Marburg virus siRNA sense strand
gucaaugugaauguaaauuaa

SEQ ID NO: 39031 - RNA, 21 nt, Artificial Sequence
  Marburg virus siRNA sense strand
ucaaugugaauguaaauuaag

SEQ ID NO: 39032 - RNA, 21 nt, Artificial Sequence
  Marburg virus siRNA sense strand
caaugugaauguaaauuaaga

SEQ ID NO: 39033 - RNA, 21 nt, Artificial Sequence
  Marburg virus siRNA sense strand
aaugugaauguaaauuaagaa

SEQ ID NO: 39034 - RNA, 21 nt, Artificial Sequence
  Marburg virus siRNA sense strand
augugaauguaaauuaagaaa

SEQ ID NO: 39035 - RNA, 21 nt, Artificial Sequence
  Marburg virus siRNA sense strand
ugugaauguaaauuaagaaaa

SEQ ID NO: 39036 - RNA, 21 nt, Artificial Sequence
  Marburg virus siRNA sense strand
gugaauguaaauuaagaaaaa

SEQ ID NO: 39037 - RNA, 21 nt, Artificial Sequence
  Marburg virus siRNA sense strand
ugaauguaaauuaagaaaaac

SEQ ID NO: 39038 - RNA, 21 nt, Artificial Sequence
  Marburg virus siRNA sense strand
gaauguaaauuaagaaaaacc

SEQ ID NO: 39039 - RNA, 21 nt, Artificial Sequence
  Marburg virus siRNA sense strand
aauguaaauuaagaaaaacca

SEQ ID NO: 39040 - RNA, 21 nt, Artificial Sequence
  Marburg virus siRNA sense strand
auguaaauuaagaaaaaccaa

SEQ ID NO: 39041 - RNA, 21 nt, Artificial Sequence
  Marburg virus siRNA sense strand
uguaaauuaagaaaaaccaau

SEQ ID NO: 39042 - RNA, 21 nt, Artificial Sequence
  Marburg virus siRNA sense strand
guaaauuaagaaaaaccaaua

SEQ ID NO: 39043 - RNA, 21 nt, Artificial Sequence
  Marburg virus siRNA sense strand
uaaauuaagaaaaaccaauau

SEQ ID NO: 39044 - RNA, 21 nt, Artificial Sequence
  Marburg virus siRNA sense strand
aaauuaagaaaaaccaauaua

SEQ ID NO: 39045 - RNA, 21 nt, Artificial Sequence
  Marburg virus siRNA sense strand
aauuaagaaaaaccaauauau

SEQ ID NO: 39046 - RNA, 21 nt, Artificial Sequence
  Marburg virus siRNA sense strand
auuaagaaaaaccaauauaua

SEQ ID NO: 39047 - RNA, 21 nt, Artificial Sequence
  Marburg virus siRNA sense strand
uuaagaaaaaccaauauauaa

SEQ ID NO: 39048 - RNA, 21 nt, Artificial Sequence
  Marburg virus siRNA sense strand
uaagaaaaaccaauauauaaa

SEQ ID NO: 39049 - RNA, 21 nt, Artificial Sequence
  Marburg virus siRNA sense strand
aagaaaaaccaauauauaaaa

SEQ ID NO: 39050 - RNA, 21 nt, Artificial Sequence
  Marburg virus siRNA sense strand
agaaaaaccaauauauaaaau

SEQ ID NO: 39051 - RNA, 21 nt, Artificial Sequence
  Marburg virus siRNA sense strand
gaaaaaccaauauauaaaauu

SEQ ID NO: 39052 - RNA, 21 nt, Artificial Sequence
  Marburg virus siRNA sense strand
aaaaaccaauauauaaaauua

SEQ ID NO: 39053 - RNA, 21 nt, Artificial Sequence
  Marburg virus siRNA sense strand
aaaaccaauauauaaaauuaa

SEQ ID NO: 39054 - RNA, 21 nt, Artificial Sequence
  Marburg virus siRNA sense strand
aaaccaauauauaaaauuaaa

SEQ ID NO: 39055 - RNA, 21 nt, Artificial Sequence
  Marburg virus siRNA sense strand
aaccaauauauaaaauuaaaa

SEQ ID NO: 39056 - RNA, 21 nt, Artificial Sequence
  Marburg virus siRNA sense strand
accaauauauaaaauuaaaaa

SEQ ID NO: 39057 - RNA, 21 nt, Artificial Sequence
  Marburg virus siRNA sense strand
ccaauauauaaaauuaaaaaa

SEQ ID NO: 39058 - RNA, 21 nt, Artificial Sequence
  Marburg virus siRNA sense strand
caauauauaaaauuaaaaaau

SEQ ID NO: 39059 - RNA, 21 nt, Artificial Sequence
  Marburg virus siRNA sense strand
aauauauaaaauuaaaaaauu

SEQ ID NO: 39060 - RNA, 21 nt, Artificial Sequence
  Marburg virus siRNA sense strand
auauauaaaauuaaaaaauua

SEQ ID NO: 39061 - RNA, 21 nt, Artificial Sequence
  Marburg virus siRNA sense strand
uauauaaaauuaaaaaauuaa

SEQ ID NO: 39062 - RNA, 21 nt, Artificial Sequence
  Marburg virus siRNA sense strand
auauaaaauuaaaaaauuaaa

SEQ ID NO: 39063 - RNA, 21 nt, Artificial Sequence
  Marburg virus siRNA sense strand
uauaaaauuaaaaaauuaaaa

SEQ ID NO: 39064 - RNA, 21 nt, Artificial Sequence
  Marburg virus siRNA sense strand
auaaaauuaaaaaauuaaaaa

SEQ ID NO: 39065 - RNA, 21 nt, Artificial Sequence
  Marburg virus siRNA sense strand
uaaaauuaaaaaauuaaaaaa

SEQ ID NO: 39066 - RNA, 21 nt, Artificial Sequence
  Marburg virus siRNA sense strand
aaaauuaaaaaauuaaaaaac

SEQ ID NO: 39067 - RNA, 21 nt, Artificial Sequence
  Marburg virus siRNA sense strand
aaauuaaaaaauuaaaaaacu

SEQ ID NO: 39068 - RNA, 21 nt, Artificial Sequence
  Marburg virus siRNA sense strand
aauuaaaaaauuaaaaaacuu

SEQ ID NO: 39069 - RNA, 21 nt, Artificial Sequence
  Marburg virus siRNA sense strand
auuaaaaaauuaaaaaacuuu

SEQ ID NO: 39070 - RNA, 21 nt, Artificial Sequence
  Marburg virus siRNA sense strand
uuaaaaaauuaaaaaacuuug

SEQ ID NO: 39071 - RNA, 21 nt, Artificial Sequence
  Marburg virus siRNA sense strand
uaaaaaauuaaaaaacuuuga

SEQ ID NO: 39072 - RNA, 21 nt, Artificial Sequence
  Marburg virus siRNA sense strand
aaaaaauuaaaaaacuuugau

SEQ ID NO: 39073 - RNA, 21 nt, Artificial Sequence
  Marburg virus siRNA sense strand
aaaaauuaaaaaacuuugaua

SEQ ID NO: 39074 - RNA, 21 nt, Artificial Sequence
  Marburg virus siRNA sense strand
aaaauuaaaaaacuuugauau

SEQ ID NO: 39075 - RNA, 21 nt, Artificial Sequence
  Marburg virus siRNA sense strand
aaauuaaaaaacuuugauaua

SEQ ID NO: 39076 - RNA, 21 nt, Artificial Sequence
  Marburg virus siRNA sense strand
aauuaaaaaacuuugauauaa

SEQ ID NO: 39077 - RNA, 21 nt, Artificial Sequence
  Marburg virus siRNA sense strand
auuaaaaaacuuugauauaag

SEQ ID NO: 39078 - RNA, 21 nt, Artificial Sequence
  Marburg virus siRNA sense strand
uuaaaaaacuuugauauaagu

SEQ ID NO: 39079 - RNA, 21 nt, Artificial Sequence
  Marburg virus siRNA sense strand
uaaaaaacuuugauauaagua

SEQ ID NO: 39080 - RNA, 21 nt, Artificial Sequence
  Marburg virus siRNA sense strand
aaaaaacuuugauauaaguaa

SEQ ID NO: 39081 - RNA, 21 nt, Artificial Sequence
  Marburg virus siRNA sense strand
aaaaacuuugauauaaguaac

SEQ ID NO: 39082 - RNA, 21 nt, Artificial Sequence
  Marburg virus siRNA sense strand
aaaacuuugauauaaguaaca

SEQ ID NO: 39083 - RNA, 21 nt, Artificial Sequence
  Marburg virus siRNA sense strand
aaacuuugauauaaguaacac

SEQ ID NO: 39084 - RNA, 21 nt, Artificial Sequence
  Marburg virus siRNA sense strand
aacuuugauauaaguaacaca

SEQ ID NO: 39085 - RNA, 21 nt, Artificial Sequence
  Marburg virus siRNA sense strand
acuuugauauaaguaacacaa

SEQ ID NO: 39086 - RNA, 21 nt, Artificial Sequence
  Marburg virus siRNA sense strand
cuuugauauaaguaacacaaa

SEQ ID NO: 39087 - RNA, 21 nt, Artificial Sequence
  Marburg virus siRNA sense strand
uuugauauaaguaacacaaaa

SEQ ID NO: 39088 - RNA, 21 nt, Artificial Sequence
  Marburg virus siRNA sense strand
uugauauaaguaacacaaaac

SEQ ID NO: 39089 - RNA, 21 nt, Artificial Sequence
  Marburg virus siRNA sense strand
ugauauaaguaacacaaaaca

SEQ ID NO: 39090 - RNA, 21 nt, Artificial Sequence
  Marburg virus siRNA sense strand
gauauaaguaacacaaaacau

SEQ ID NO: 39091 - RNA, 21 nt, Artificial Sequence
  Marburg virus siRNA sense strand
auauaaguaacacaaaacauu

SEQ ID NO: 39092 - RNA, 21 nt, Artificial Sequence
  Marburg virus siRNA sense strand
uauaaguaacacaaaacauuc

SEQ ID NO: 39093 - RNA, 21 nt, Artificial Sequence
  Marburg virus siRNA sense strand
auaaguaacacaaaacauucu

SEQ ID NO: 39094 - RNA, 21 nt, Artificial Sequence
  Marburg virus siRNA sense strand
uaaguaacacaaaacauucuu

SEQ ID NO: 39095 - RNA, 21 nt, Artificial Sequence
  Marburg virus siRNA sense strand
aaguaacacaaaacauucuuc

SEQ ID NO: 39096 - RNA, 21 nt, Artificial Sequence
  Marburg virus siRNA sense strand
aguaacacaaaacauucuuca

SEQ ID NO: 39097 - RNA, 21 nt, Artificial Sequence
  Marburg virus siRNA sense strand
guaacacaaaacauucuucau

SEQ ID NO: 39098 - RNA, 21 nt, Artificial Sequence
  Marburg virus siRNA sense strand
uaacacaaaacauucuucauc

SEQ ID NO: 39099 - RNA, 21 nt, Artificial Sequence
  Marburg virus siRNA sense strand
aacacaaaacauucuucaucu

SEQ ID NO: 39100 - RNA, 21 nt, Artificial Sequence
  Marburg virus siRNA sense strand
acacaaaacauucuucaucuu

SEQ ID NO: 39101 - RNA, 21 nt, Artificial Sequence
  Marburg virus siRNA sense strand
cacaaaacauucuucaucuuu

SEQ ID NO: 39102 - RNA, 21 nt, Artificial Sequence
  Marburg virus siRNA sense strand
acaaaacauucuucaucuuuu

SEQ ID NO: 39103 - RNA, 21 nt, Artificial Sequence
  Marburg virus siRNA sense strand
caaaacauucuucaucuuuuu

SEQ ID NO: 39104 - RNA, 21 nt, Artificial Sequence
  Marburg virus siRNA sense strand
aaaacauucuucaucuuuuuu

SEQ ID NO: 39105 - RNA, 21 nt, Artificial Sequence
  Marburg virus siRNA sense strand
aaacauucuucaucuuuuuug

SEQ ID NO: 39106 - RNA, 21 nt, Artificial Sequence
  Marburg virus siRNA sense strand
aacauucuucaucuuuuuugu

SEQ ID NO: 39107 - RNA, 21 nt, Artificial Sequence
  Marburg virus siRNA sense strand
acauucuucaucuuuuuugug

SEQ ID NO: 39108 - RNA, 21 nt, Artificial Sequence
  Marburg virus siRNA sense strand
cauucuucaucuuuuuugugu

SEQ ID NO: 39109 - RNA, 21 nt, Artificial Sequence
  Marburg virus siRNA sense strand
auucuucaucuuuuuugugug

SEQ ID NO: 39110 - RNA, 21 nt, Artificial Sequence
  Marburg virus siRNA sense strand
uucuucaucuuuuuugugugu

SEQ ID NO: 39111 - RNA, 21 nt, Artificial Sequence
  Marburg virus siRNA sense strand
ucuucaucuuuuuuguguguc

SEQ ID NO: 39112 - RNA, 21 nt, Artificial Sequence
  Marburg virus siRNA sense strand
cuucaucuuuuuugugugucc

SEQ ID NO: 39113 - RNA, 21 nt, Artificial Sequence
  Marburg virus siRNA sense strand
uucaucuuuuuugugugucca

SEQ ID NO: 39114 - DNA, 21 bp, Artificial Sequence
  Ebola virus polymerase complex protein VP35 siRNA sense strand EBL-VP35-6
  Description of Combined DNA/RNA Molecule:Ebola virus polymerase complex protein VP35 siRNA sense strand
gguaguacaaacauuagcutt

SEQ ID NO: 39115 - DNA, 21 bp, Artificial Sequence
  Ebola virus polymerase complex protein VP35 siRNA antisense strand EBL-VP35-6
  Description of Combined DNA/RNA Molecule:Ebola virus polymerase complex protein VP35 siRNA antisense strand
agcuaauguuuguacuacctt

SEQ ID NO: 39116 - DNA, 21 bp, Artificial Sequence
  Ebola virus membrane-associated protein VP24 siRNA sense strand EBL-VP24-6
  Description of Combined DNA/RNA Molecule:Ebola virus membrane-associated protein VP24 siRNA sense strand
gguuuauuggggcugguautt

SEQ ID NO: 39117 - DNA, 21 bp, Artificial Sequence
  Ebola virus membrane-associated protein VP24 siRNA antisense strand EBL-VP24-6
  Description of Combined DNA/RNA Molecule:Ebola virus membrane-associated protein VP24 siRNA antisense strand
auaccagccccaauaaacctt

SEQ ID NO: 39118 - DNA, 21 bp, Artificial Sequence
  Ebola virus polymerase complex minor nucleoprotein VP30 siRNA sense strand EBL-VP30-1
  Description of Combined DNA/RNA Molecule:Ebola virus polymerase complex minor nucleoprotein VP30 siRNA sense strand
ggugaguaccgucaaucaatt

SEQ ID NO: 39119 - DNA, 21 bp, Artificial Sequence
  Ebola virus polymerase complex minor nucleoprotein VP30 siRNA antisense strand EBL-VP30-1
  Description of Combined DNA/RNA Molecule:Ebola virus polymerase complex minor nucleoprotein VP30 siRNA antisense strand
uugauugacgguacucacctt

SEQ ID NO: 39120 - DNA, 21 bp, Artificial Sequence
  Ebola virus nucleoprotein (NP) siRNA sense strand EBL-NP-1
  Description of Combined DNA/RNA Molecule:Ebola virus nucleoprotein (NP) siRNA sense strand
acugauacaauauccaauutt

SEQ ID NO: 39121 - DNA, 21 bp, Artificial Sequence
  Ebola virus nucleoprotein (NP) siRNA antisense strand EBL-NP-1
  Description of Combined DNA/RNA Molecule:Ebola virus nucleoprotein (NP) siRNA antisense strand
aauuggauauuguaucagutt

SEQ ID NO: 39122 - DNA, 21 bp, Artificial Sequence
  Ebola virus nucleoprotein (NP) siRNA sense strand EBL-NP-2
  Description of Combined DNA/RNA Molecule:Ebola virus nucleoprotein (NP) siRNA sense strand
agagugcggacaguuuccutt

SEQ ID NO: 39123 - DNA, 21 bp, Artificial Sequence
  Ebola virus nucleoprotein (NP) siRNA antisense strand EBL-NP-2
  Description of Combined DNA/RNA Molecule:Ebola virus nucleoprotein (NP) siRNA antisense strand
aggaaacuguccgcacucutt

SEQ ID NO: 39124 - DNA, 21 bp, Artificial Sequence
  Ebola virus nucleoprotein (NP) siRNA sense strand EBL-NP-3
  Description of Combined DNA/RNA Molecule:Ebola virus nucleoprotein (NP) siRNA sense strand
gcuaaugccggucaguuuctt

SEQ ID NO: 39125 - DNA, 21 bp, Artificial Sequence
  Ebola virus nucleoprotein (NP) siRNA antisense strand EBL-NP-3
  Description of Combined DNA/RNA Molecule:Ebola virus nucleoprotein (NP) siRNA antisense strand
gaaacugaccggcauuagctt
